United States Patent 12,577,609 (METHODS FOR CELL-TYPE SPECIFIC PROFILING TO IDENTIFY DRUG TARGETS) - sequence listing, part 2

SEQ ID NO: 223 - DNA, 3315 bp, Homo sapiens
  ENST00000531338
caaaaagtggcctttgactttgctgcccgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccgcgagaaaccacctttggaaggttcacagcagccccaatttagcactctgccatgtttacattgtcaggctgcattgccactagggggaaccatagctttttatcatcccagccagggtggctgtgggcagcttctgcctggcaggtaataagggagaggggcagagggctttgagtcgcctgtctggggggaactgacaagtttagtaggtgaacttcccttgtctctaaccatacagaatgtggaggccctctttgagcttggctgtttgtggttctttcatgggtttatggcgggctgccagatcgtgggctggggtaggaagggaagctgcttgctccacagtcttcccagagtccaagacgtctagtccctgtctccctgcagatctgcaaccaggccttgcagatgcacgggggctacggctacctgaaggattacgctgttcagcagtacgtgcgggactccagggtccaccagattctagaaggtaaaaattgccagaggttattctcttcccttcagaacgggggcgggatcgctgctttccccactctctgtccccatgcctcctgggcctcagggtgcagtcaagccctgtctgtctcgaggcttcctcctccctcccgttccgcagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccggggcttttctctaaggttatcgagtacgtggttctcagggatccaagaacagtgatggacaaggcaaatgtgagccagtatggtcatcagtagctctatattgattatcagccagatggcctaaaagatacctgtctcaatattactagtgtatttttcaataaaataaaccatcactatatgggtatcttcttggtagtcacagacattctatcgaggaaacatggaagccgttggggtcgggctcggagcctggctgtctccactctctacagccagtgcggaagtcttgaaatgacacgactcttggaaaagcaggaggggcagaggcttctttgagtgacttcggtgaagcaacgtgaggctgccttgctggaaacattatataatggggcttccctgcccctttcacagcacccttctcaaacctcagcctgtgctggaatcgcctggagggcatgggagcgcagattgcgggcctcaaccccagagcttctgctccagagggtctagtgtgggcctgggaatttgtatctgcaacaagtcttcaagtgaggctgccacagcttgtctgagaaccacactttgagacccaccgctctggtgttaatgtcagagtcacaggctaccacaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggctttt

SEQ ID NO: 224 - DNA, 1071 bp, Homo sapiens
  ENST00000528325
cgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtgagtggctgttggacaggaaacaattcaggttatgagactctgccacctgccagcccaactcctgctctatttcagaaaacaggtttgcatacttgctaacctacctttgaagcagttgcttctattaggattttcaacaggagcatatgaaatacaacagggcattattaaacactaggcctctggggaaagtgacaatgtttgccagtaaattcttcaagccacctgtgagtgttctgacctctcctgcctctgcttttggcctgtgttccttatccagctgcttacgttggtgcactttgttgctccaggaagagacgcttagagaagacctggtgttggccacaagtctcagtaatggaaggcgtgtggtcccttttgcttctttgattaaaaataaagtaaaactcattggagatgattgtgggtatttcagcaacccaagaaggacacttaggtactgtaagtaatttgaaaagtaagatacttctaggattaagagccgccatggccagggcatgaacaggagacttg

SEQ ID NO: 225 - DNA, 1475 bp, Homo sapiens
  ENST00000527665
tattgcttagggaatcaggtcagccagctttctcagaaatcttattttgagctggtaccaggagacttctccaatagagtgatcagggtcctctcacccttttatttatttatttatttttaagacagagtctcgctctgttgcccaggctagggtgcagtggcatgacctcggctcactgcaacctccgtctccccggttcaagtgattctcctgcctcagcctcctgagtagctgggattacaggcacgtgccaccacacctggctaattttttttcatatttagtagagatggggtttcaccatgttagtcaggctggtctcaaactcctgaccttgtgttctgcctgcctcggcctcccatagtgctgggattacagatgtgagccaccgcacccggcccctctcacccttttcctcaatccaaagatggaactgccagtgatttgaggaagtaatagaaactactaatagaaagcacatataactctgatttttagaggctcgtgtaacctaactagaagtagtacaaacgtgctggtgagaagtacctcagcctggttatctctgggtagtccttattccaggaatatgttttaatccaccgtttgcctttaaagagtcttcccaattgtgactctccccttcccactcttctgctttactccactgccctgccctttgttctctttccccttctcccccatttttttttcttttccatctttatttctgtcattgtcttttcttcttggtgtacctatcagcatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgct

SEQ ID NO: 226 - DNA, 467 bp, Homo sapiens
  ENST00000527713
acactctgagcagggtctgtttagagaagatttcctagaagatagaattgtgctgggctccctcgacctcactgactttctcaccttctctctgctgccttttgatccctcctcaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattg

SEQ ID NO: 227 - DNA, 1032 bp, Homo sapiens
  ENST00000524739
actgtttgtatctctcctaatctgattccagatcatttcgttgacttttgtctatcctttttatactctcttggactgcctctctgatctgcagtcactgcagcgaccttttacctcacctcagtctctgtgccattggaccttattgtcagtctctgtgccattggaccttattgtcagtctctgtgccattggaccttattgtcagtctctgtgccattggaccttattgtcagtctctgtgccattggaccttattgtcagtctctgtgccattggaccttattgtcaggaggacccagtggtgttcccagacgctgtgagaactcaagcattccctggtccttttgcaccccttttacccccacaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaagctgcttacgttggtgcactttgttgctccaggaagagacgcttagagaagacctggtgttggccacaagtctcagtaatggaaggcgtgtggtcccttttgcttctttgattaaaaataaagtaaaactcattggagatgattgtgggtatttcagcaacccaagaaggacacttaggtactgtaagtaatttgaaaagtaagatacttctaggattaagagccgccatggccagggcatgaacaggagacttgtgatcatgtaaccgtaattggtaataagggctcaagacccattcagattttttagaccagatgctcaaagcagtcatctctctctagtttgtactgttatggggggactttgtgagagaaggcaggtaatgaaatgacccctaagtgtacctctttctcacagctcctcgggtttctgtattttcctacaggatccttcctgatcctctgtaactgtaaggcattatgcattttagcatccccttctctttggtaacacagcaaccattt

SEQ ID NO: 228 - DNA, 1487 bp, Homo sapiens
  ENST00000524502
tgtttacattgtcaggctgcattgccactagggggaaccatagctttttatcatcccagccagggtggctgtgggcagcttctgcctggcagatctgcaaccaggccttgcagatgcacgggggctacggctacctgaaggattacgctgttcagcagtacgtgcgggactccagggtccaccagattctagaagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccggggcttttctctaaggttatcgagtacgtggttctcagggatccaagaacagtgatggacaaggcaaatgtgagccagtatggtcatcagtagctctatattgattatcagccagatggcctaaaagatacctgtctcaatattactagtgtatttttcaataaaataaaccatcactatatgggtatcttcttggtagtcacagacattctatcgaggaaacatggaagccgttggggtcgggctcggagcctggctgtctccactctctacagccagtgcggaagtcttgaaatgacacgactcttggaaaagcaggaggggcagaggcttctttgagtgacttcggtgaagcaacgtgaggctgccttgctggaaacattatataatggggcttccctgcccctttcacagcacccttctcaaacctcagcctgtgctggaatcgcctggagggcatgggagcgcagattgcgggcctcaaccccagagcttctgctccagagggtctagtgtgggcctgggaatttgtatctgcaacaagtcttcaagtgaggctgccacagcttgtctgagaaccacactttgagacccaccgctctggtgttaatgtcagagtcacaggctaccacaggttagaccgctgctttcttctgcaaacctcattccagaaagatgtttatgggctcagtcgccagtgttcaaactgaattcccgagagtcgttttccttccattactcttggaattgctttctcactgagctttatgtgcgtaggaaacttcgccttcattctaactctctctccaccctgcaataataagcaggaaaacatttattgtaggccacaccatcacccacttacagaagaattggggcactcatcactgtatcactttgtttcatcatggactttactgttggataaatctacagtttatgctttatttgagacgatgtgactactgattcctcgagggggtttatatttctttttgcattaaaggccactgctaaaaatgaagcaaataattgataccctcctttcagggaaaatgttttcattcttttgtaagtcagttttctgattaccaaagaaatgtgtatttattgttgaaaccttataaaattaggaaaagt

SEQ ID NO: 229 - DNA, 3896 bp, Homo sapiens
  ENST00000354700
agtgacagcgggcggtgcgcgcgggcggctgactttggcgacgctccccggcggtgacaggcggggcggggcgcggcgcggcggcctcattccggggcgggcgggcgccgaggcggcgcgggcgggacgagcggtccgggccggcgcggctgccgctcggcgccgcggtcctcgtgccagtgagcgccgcggccgccgcagccatgaccgtggagttcgaggagtgcgtcaaggactccccgcgcttcagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgagctggaccagctggtgatcgactctgcggtggaaaagcgtgagatggagcgaaagcacgccgccatccagcagcggacgctgctgcaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcagtctgagtagcgacagtggccttgggggcagctcggatggcagctcggacgtcctggctttcggctcgggctctgtggtggacagcgtcactgaggaggagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctagggccgggcaggccgggcagctgccaccccgcccggcccgacgccccgcatgccccgaagtccctggcgcccacccggccgcggccctgcgtgtgacccgcgggtcgatacctggcagccccagtgctggggcgccgcggccctgctcgcccaggaggagagcgagggccccacactgagtctcttgaagcctcacgtttccctgggggggtgctgcatcgtcgggtgtccctcaccccacctggggaacctctgtcttcaggtcaccccttttcaggggcctgggttgctcatgtcacaagccacttttaaggcccgtgtcacctgtgtccctgtgtcctcagggcctgtgttacttcgtgccccacttctgcccagaacactgacctgttagctggctccctcctgcacaccccagagcctcctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgcagccctcatctcatgttctttgtagcggaccgagtgggtttgctataggcctcgtctgactttgtcttgcgtcttttctctgtggactcttgaggacgcctgagccccagccctgcccctgaccagcctcccccttgggtccaggggtctttcggctcatattgcagggcctgccaatgccttcacgcaccccttccccaaaggtgcccggcagggaggcagggcctcccccactcagcgcaggtcaggctaaggccagtcggctggtcactatgcaatgctgccctggggaggctccctgagggcacagtgggcgctggacccggccccccaactctcttgcctgctgcctgtgaccctgaagaacagaattgattcttgcccctctccctgtgtgagcttggccccgcctcttgccccaggcccctgctggcgggtctcaccccccacccctcgctttgaataaagcacttgcgcccactgcctgctcctggg

SEQ ID NO: 230 - DNA, 5319 bp, Homo sapiens
  ENST00000492936
tgtaacgtggagcctggtcgccccagcccgggagagggggaccctgcccgcaccctcctggtctggggagggcctagtggcagcccaggtgcagtgggccggaggccaggggagcccgtgtaggggaaccgcctggcctctgttcagtgtgcccctcccctgggtggggcttcaggcgctgagtcatggctttggttggggggcagcctcaccctcctccccgtcctccaagctgctgaggaaatcctgggctgagcacagcagaggaggcctaggtccccaggactgaggaagggagagctgaggggctcccagcagtgggagcggctctcggggcctctgccagggcccaccctgtccccatgagcacgtccgtgagctcctgggtgcagccatccccccttgctggctctccagggacacgggcgccccaaacccgagggcggcagctctgggtgcagctgtctctgcatccggccctgctcaggggtggctgcaactcctggggtgtggcgctctctgctgccttctcctgggaggatggtcccttctctgttctgggatcctccagctgaggtagaggtcagggtccaggggctgcaggctgggcactggcggtcagcggacaccacagcgagattccctccatcgccccctgcttcgggattcagagtcctcttagccccttgggaacaagagagggctgctcagagaggacctagtgtccttctggggtggctgggacccttcaaggtccctggctggggcagcctggtgcctgcagctccagctcctaattgaggacacgccccatgtaaaccacaggcccctcccccgaggcctgggacaccggtcagggtagcaaggtacgagggactgtaggccctgatggcctctgctcctggacccctgccctagacctggagtcctggccccagcccgggccctgtggtgcccaatccccaggaggccagatggcccggacagccagtgagccgattgtgtggagggctgccgggatcctggccctgtttccctgttgcctgctcccggagggggtggtcacgtgcccgatccatctgcctcctgtcttccggggattctcccgccgaggcttctctggtgatgtcatgccttaactcttctctccccaggcagccccactgtcaggctgtcctggtgggagtgggctctgaggaggatggcctacccgtctttccagcggaccatgccgcttgcagctgtgaggttgggggagccgggggcgtctctccccagctggtctgggtcctcctggtgctgccaggaccgagagcagctgccctactgcccccaccctgtcccacagtgcatgggtgccagacctggatgggctgcagtagtgcagtggggtgaggggaggtgccgcagggttgaggggctccagatgggtccagggttgactctgaactcctagaggagaggcgggtgaggctggctcagcccttggtgggcactgtccctgagggactcccagcggccggctgtcctgggagaggctggtccagccttcttccccgagggcacagcagcggctgcctctgcctgcctggggttgggggggcggggggaagtgcactgaacctggtcccagtcctgcccccgtagcaggcaggcgtctgtctcccagcctgtttcctgaaagccccttcccatggtggagcccctcagggaggtgcggggggaggtgaagccccgagggggctgaggctgcaggtgaccccagccagccccgttcttgctttagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgagctggaccagctggtgatcgactctgcggtggaaaagcgtgagatggagcgaaagcacgccgccatccagcagcggacgctgctgcaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcaagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctagggccgggcaggccgggcagctgccaccccgcccggcccgacgccccgcatgccccgaagtccctggcgcccacccggccgcggccctgcgtgtgacccgcgggtcgatacctggcagccccagtgctggggcgccgcggccctgctcgcccaggaggagagcgagggccccacactgagtctcttgaagcctcacgtttccctgggggggtgctgcatcgtcgggtgtccctcaccccacctggggaacctctgtcttcaggtcaccccttttcaggggcctgggttgctcatgtcacaagccacttttaaggcccgtgtcacctgtgtccctgtgtcctcagggcctgtgttacttcgtgccccacttctgcccagaacactgacctgttagctggctccctcctgcacaccccagagcctcctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgcagccctcatctcatgttctttgtagcggaccgagtgggtttgctataggcctcgtctgactttgtcttgcgtcttttctctgtggactcttgaggacgcctgagccccagccctgcccctgaccagcctcccccttgggtccaggggtctttcggctcatattgcagggcctgccaatgccttcacgcaccccttccccaaaggtgcccggcagggaggcagggcctcccccactcagcgcaggtcaggctaaggccagtcggctggtcactatgcaatgctgccctggggaggctccctgagggcacagtgggcgctggacccggccccccaactctcttgcctgctgcctgtgaccctgaagaacagaattgattcttgcccctctccctgtgtgagcttggccccgcctcttgccccaggcccctgctggcgggtctcaccccccacccctcgctttgaataaagcacttgcgcccac

SEQ ID NO: 231 - DNA, 2725 bp, Homo sapiens
  ENST00000467278
cagcctgctggtccctgcagggctggggtggggccggcactctcgggcccccagctgtgaacgtgaggggtctgccccacgggttgcagggctgggggccttgctcaggtcaagaagtggctgtggtgaacagagggtctctcgtctgagcgtgtggtccgtgggccgtgtggcagcctcagacaaggacctcacccccacctgtgctccgggaaagcacggagggtagcagggcccctggggtgggcactgagggggcgggttccatccccccaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcagtctgagtagcgacagtggccttgggggcagctcggatggcagctcggacgtcctggctttcggctcgggctctgtggtggacagcgtcactgaggaggagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctagggccgggcaggccgggcagctgccaccccgcccggcccgacgccccgcatgccccgaagtccctggcgcccacccggccgcggccctgcgtgtgacccgcgggtcgatacctggcagccccagtgctggggcgccgcggccctgctcgcccaggaggagagcgagggccccacactgagtctcttgaagcctcacgtttccctgggggggtgctgcatcgtcgggtgtccctcaccccacctggggaacctctgtcttcaggtcaccccttttcaggggcctgggttgctcatgtcacaagccacttttaaggcccgtgtcacctgtgtccctgtgtcctcagggcctgtgttacttcgtgccccacttctgcccagaacactgacctgttagctggctccctcctgcacaccccagagcctcctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgca

SEQ ID NO: 232 - DNA, 421 bp, Homo sapiens
  ENST00000470659
cctttgagctgttatttggttttctctcctttgctcctagcctgcagctggctccccccggccctgggtgggagctggtcctgtccctaggggtggcccctggagggtgggtggagttccagccttgccccagggctctggacggagtctgggcctcccaccctcaggacccccttccctgcggacctgcaggtctgagtagcgacagtggccttgggggcagctcggatggcagctcggacgtcctggctttcggctcgggctctgtggtggacagcgtcactgaggaggagggtgcagagtcggaggagtccagcggtgaggcagacggggacactgaggccgaggcctggggcctggcggacgtgcgcgagctgcacccggggctcttggcgcaccgcgcagcgcgtgcccgcgacct

SEQ ID NO: 233 - DNA, 492 bp, Homo sapiens
  ENST00000379037
acgccggagccggaacagtcagggagcagagagctggacacggggcttggggctcaggcagtcggcctccgggtctccaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctcc

SEQ ID NO: 234 - DNA, 819 bp, Homo sapiens
  ENST00000476572
cggtggtcacctctgtggcctcagtcactggctccttgcggggcctttgcttgcctgtgggacagcagccccggccaccatcccgggcagaggttggctgcaggcaggagtggctattttgggataggggagagccccccaggagttggggacgggtccaccagtcaccaggagttggggacgggtccaccagtcaccaggagttggcagccgtcactcactggctttctccccctaccccctcctgctccggccctccagacgctgctgcaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaac

SEQ ID NO: 235 - DNA, 326 bp, Homo sapiens
  ENST00000493992
agcagagagctggacacggggcttggggctcaggcagtcggcctccgggtctccaaggtgaagcaggaagtgggtggtcggggccgggtggtggctgagggcaggggccacagcggtgccgcccacaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgac

SEQ ID NO: 236 - DNA, 1946 bp, Homo sapiens
  ENST00000472541
actcactctgccgggagagtccagcataggttgcgttcaaacaccggcagctcatcacgccggtgacagccagtggccaggcggtacaggtaggtccgggacgtggctgcgtgacgagcgtggaagtcgctgggcactcggaaggcccgcaggaccctatggcggcagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgagctggaccagctggtgatcgactctgcggtggaaaagcgtgagatggagcgaaagcacgccgccatccagcagcgggtgaggccgcgcagccggctccctgcacaccaggcgcctgggaggcccctgcgtcctcaccccatgcccggcacaccctccccgccccttcctcctgcctgtctcccacctgccctgcccacaccctctctaggggaccaaggctgctccctttgatgtgtgcagtggaggggcacgtgtgggtggggccgctgctgggatctccttttgaggcggtggtcacctctgtggcctcagtcactggctccttgcggggcctttgcttgcctgtgggacagcagccccggccaccatcccgggcagaggttggctgcaggcaggagtggctattttgggataggggagagccccccaggagttggggacgggtccaccagtcaccaggagttggggacgggtccaccagtcaccaggagttggcagccgtcactcactggctttctccccctaccccctcctgctccggccctccagacgctgctgcaggtaagtgagcacgggccctgggcgggctgtgggtcgggggagaccagatggggcggtgcctttccctcctctaccccaagggcacttcagcaccaaggacacctcccaccagtctcggctcctgctgctgatgcggctgtgaggggctggctccggccagacctccacattccccgtggggttggcggcagctgtcccttcccatcccatgtggcctggggagcaggtggccgcccctcccctctgcttccctggcctgccagatggcgggacacacagggccctcagtgactcccaggcctcctgaatggggctctgtccgcccagctggccacatgaatggggcactcaggatgcggagggtgggggcgcagcttccttcctgatcgcagcctgctggtccctgcagggctggggtggggccggcactctcgggcccccagctgtgaacgtgaggggtctgccccacgggttgcagggctgggggccttgctcaggtcaagaagtggctgtggtgaacagagggtctctcgtctgagcgtgtggtccgtgggccgtgtggcagcctcagacaaggacctcacccccacctgtgctccgg

SEQ ID NO: 237 - DNA, 582 bp, Homo sapiens
  ENST00000354980
gcagccatgaccgtggagttcgaggagtgcgtcaaggactccccgcgcttcagagcagcgcgtggggaacaggcagctggagccgcgtttaaggcctgggggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatg

SEQ ID NO: 238 - DNA, 2393 bp, Homo sapiens
  ENST00000478065
ctgtttccctgttgcctgctcccggagggggtggtcacgtgcccgatccatctgcctcctgtcttccggggattctcccgccgaggcttctctggtgatgtcatgccttaactcttctctccccaggcagccccactgtcaggctgtcctggtgggagtgggctctgaggaggatggcctacccgtctttccagcggaccatgccgcttgcagctgtgaggttgggggagccgggggcgtctctccccagctggtctgggtcctcctggtgctgccaggaccgagagcagctgccctactgcccccaccctgtcccacagtgcatgggtgccagacctggatgggctgcagtagtgcagtggggtgaggggaggtgccgcagggttgaggggctccagatgggtccagggttgactctgaactcctagaggagaggcgggtgaggctggctcagcccttggtgggcactgtccctgagggactcccagcggccggctgtcctgggagaggctggtccagccttcttccccgagggcacagcagcggctgcctctgcctgcctggggttgggggggcggggggaagtgcactgaacctggtcccagtcctgcccccgtagcaggcaggcgtctgtctcccagcctgtttcctgaaagccccttcccatggtggagcccctcagggaggtgcggggggaggtgaagccccgagggggctgaggctgcaggtgaccccagccagccccgttcttgctttagggcgaccattgacgaggtggagacggacgtggtggagattgaggccaaactggacaaggtgaagggcgggcctggagcgccctgtgcccggccaagcttgggatggccacatggccagactcgccctccaggccttactaagccacttacaccccccatatgtggagcatgcgtgtggtgctccaggtcctggtccctgtgtcttagcatgtgtgttccagggtgcacatgtcacatgcacacatgtggctggccctgagtctcgtcccatctgggaggggctgggctgtggtgagtccccgacccacggtggctgcccgtcccctctgctgggctggtgacacggggacagctgctgtgtgggctgagccttggtgtggctggggctggggctgagaaaggggagggggcaacaggccgtggaggggggagccgtgtccatgagccccacatgggctgagaaagagggggcaacaggccgtggagaggggagccgtgtccatgagccccacatgggctgagaaagaggagggggcaacaggccgtggagctgggagtgggcagccttatccatgagccccacatgggctggttctgctggtcctgctggccctgggtcccctgcctggctcctggtccctcccagccgagccgtggcggccccaccctcccctcccagacgggcctccaagccccaggcaggcccaggcgtgaggaagctgcaccggggcactgagtcctgagtgccaacgccctgagtggaacctaccctgggagctcttcctgcctctgagtggccgtgtgtggtggcgagtgcaggcgccagtgcccactgtgctcaccacgccccgctggcccacagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagagtgagtggcccccagggctgggggaagaacactgaggccacgctccctcccttggaggggaagggggtctggggcagagcagaggcaccttgggcccaggcctccaggctgtgcagcggctccacaaggcagaaggctcagaggcagacagccgggtggagtgcggggggttccacaccctgcatgtgtgggtggggtgtccagcccccacagcagagaggtccagtccacgttgggtttgggggtctggagtctggggcatggctggggtctgggctggacagatcttgagagtgaggtggggaggggctggggaggcctggagcagatgatcggggtcagcaggggtgcgggcaggcctgggataggctggtgaggaaggaggctatgcccaggagcaaagaaagggcctggagtggaggggggtggggctgggcatggtggctcacacctgtaatcccagcgtttgggaggccaaggccagagaatgccaggagtttgagaccagcctgggcaacgtaatgagacctccatctctac

SEQ ID NO: 239 - DNA, 485 bp, Homo sapiens
  ENST00000479108
gcggccgccgcagccatgaccgtggagttcgaggagtgcgtcaaggactccccgcgcttcagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagagtgagtggcccccagggctgggggaagaacactgaggccacgctccctcccttggaggggaagggggtctggggcagagcagaggcaccttgggcccaggcctccaggctgtgcagcggctccacaaggcag

SEQ ID NO: 240 - DNA, 265 bp, Homo sapiens
  ENST00000438966
gccatgaccgtggagttcgaggagtgcgtcaaggactccccgcgcttcagacgtgtgcacaagtgtgcatcggctttgcttggtggacatttggcaaacgacaatggaggcaaagaaacctctctgcatccccaaggcgaccattgacgaggtggagacggacgtggtggagattgaggccaaactggacaagctggtgaagctgtgcagtggcatggtggaagccggtaaggcctacgtcagcaccagcaggcttttcgtgagc

SEQ ID NO: 241 - DNA, 2280 bp, Homo sapiens
  ENST00000353662
atggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgagctggaccagctggtgatcgactctgcggtggaaaagcgtgagatggagcgaaagcacgccgccatccagcagcggacgctgctgcaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcaagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctag

SEQ ID NO: 242 - DNA, 539 bp, Homo sapiens
  ENST00000583336
agaaggggcagagccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcaggctgcctccactggcaggggactcagaagtgatccggtcacactaagtgacacttagtgatcagaagtgccccggtgccactgagtgg

SEQ ID NO: 243 - DNA, 1475 bp, Homo sapiens
  ENST00000584529
agaaggggcagagccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaccaagtatcaggggatctgtcctcctgttacccgaaacgaaacccactttgatgctggagctaagtttcatgttccaaatgtgacaccatacatcag

SEQ ID NO: 244 - DNA, 2398 bp, Homo sapiens
  ENST00000582678
agaaggggcagagccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctggtgggagccacctccccacccccaaacctgagcatgtgcatacacacagagatgctgtcccgctcaccacacagtggggctgccaccacattttaaattgaatatttaaaacaatactcaatttcgggccgggcgcggtggctcacgcctgtaatcccagcactttgggagggggaggcgggcggatcacgaggtcagatcaagaccatcctggctaacacggtgaaaccccatctctagtaaaaatacaaaaattagccgggtgtggtggcgagcacctgtagtcccagtactcaggaggctgaggcaggagaatggcatgaacccgggaggcagagcttgcagtgagccgagatggcaccactgcactccagcctgggcgacagagcgagactccatc

SEQ ID NO: 245 - DNA, 861 bp, Homo sapiens
  ENST00000579462
agagccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcaggtgggctgagggctgaggcagagctcgggggcggcctcctagtgccccatcgtgggggtcgggggagagcagcccatcagggagggaggaaccctgggatccacatgggccctgacagaagggaaagcccaggtaagcacagaatggctttctgagcattgatttttcttggagatggggtggggagttactttctgttaaaggaagcattctggagtaggaagccaaattcaaatacacttctccctaggctggtttatgagcttctttggaagagttgagaagggctgggcgtggtggctcaagcctgtaatcccagcactttgggaggctgaggtgggcgcatcgcttgagcccaggagttcaagaccagcctggccaacatggcaaaacctcgtctctacaaaaaaaaaatagct

SEQ ID NO: 246 - DNA, 4959 bp, Homo sapiens
  ENST00000290866
gagccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttaagggacatttttatgacttttatgtgtatgtttatgtagaaatttggaaaatacagaaaactgtaaagaaaataaaagccctttatatcaacgtcaagagataa

SEQ ID NO: 247 - DNA, 1002 bp, Homo sapiens
  ENST00000582627
ccgcggggcccgagcgccgggctgcgcgcacggcctgcgctcccagcatgcacgagttggatggatgagggtggctgctcccaggccgcgcccgccttcgccgaaggtgctgggcttggctctggggcccccgcgctctcgggcagctgccttctcacctccggacgctgtcgctgtcaccgtcaccgcactgcactgtccatccaccctccactcgcccggcctcttttctggtcccaatttctgctccaccattcccatgaggcagattccctccagaaggaggaagcgcggcttccgcaaactaaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcag

SEQ ID NO: 248 - DNA, 933 bp, Homo sapiens
  ENST00000580318
gagcgccgggctgcgcgcacggcctgcgctcccagcatgcacgagttggatggatgagggtggctgctcccaggccgcgcccgccttcgccgaaggtgctgggcttggctctggggcccccgcgctctcgggcagctgccttctcacctccggacgctgtcgctgtcaccgtcaccgcactgcactgtccatccaccctccactcgcccggcctcttttctggtcccaatttctgctccaccattcccatgaggcagattccctccagaaggaggaagcgcggcttccgcaaactaaggtctcccgcagggatctccccagggcccgggctctggaagcccttggccttcctcccctcccccagcaccgtggcttctcctttatggcctgcatctaagcagggtcctacaccctccctgccctcctggtgcccaataggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagag

SEQ ID NO: 249 - DNA, 867 bp, Homo sapiens
  ENST00000579726
tgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcataggtgacagtcacccatgggacaagcagccaggcaacaaccagcagccagacaaccacccaccaggcgacggcccaccagacatcagcccagagcccaagtgggaccatgcaggggaggggcagggtgccaggggtgggagaggcggggccgggtagggacagggcagggtacaagggagtgcgagagggataatggcttctggtgagaccacaaacctggagaggggaggcagaggtttgtctgtttccctgcactctgtcccacagacctggtgactgatgaggctgaggccagcaagtttgtggaggaatatgaccggacatcccaggtggtgtggaacgagtatgccgaggccaactggaactacaacaccaacatcaccacagagaccagcaagattctggcatccagggaggctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccag

SEQ ID NO: 250 - DNA, 2479 bp, Homo sapiens
  ENST00000290863
agctgcaggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccc

SEQ ID NO: 251 - DNA, 982 bp, Homo sapiens
  ENST00000582005
gcaggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgggcctttacgacacttgggggtcttctcttctctgcccctgcctggatatgtgttgcttgaccgcaggcatccagggaggctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggccca

SEQ ID NO: 252 - DNA, 1881 bp, Homo sapiens
  ENST00000578839
aggactctgctctcctgcggccatgggccagggttgggctactgcaggacttcccagcctcctcttcctgctgctctgctacgggcaccctctgctggtccccagccaggaggcatcccaacagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatgggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagc

SEQ ID NO: 253 - DNA, 2237 bp, Homo sapiens
  ENST00000413513
aggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctccc

SEQ ID NO: 254 - DNA, 2551 bp, Homo sapiens
  ENST00000579314
aggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagctctgaaattctctgagctccccttacaagcagaggtgagctaagggctggagctcaaggcattcaaacccctaccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccc

SEQ ID NO: 255 - DNA, 808 bp, Homo sapiens
  ENST00000579204
atgggccagggttgggctactgcaggacttcccagcctcctcttcctgctgctctgctacgggcaccctctgctggtccccagccaggaggcatcccaacagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagctctgaaattctctgagctccccttacaagcagaggtgagctaagggctggagctcaaggcattcaaacccctaccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacct

SEQ ID NO: 256 - DNA, 1080 bp, Homo sapiens
  ENST00000584865
atggcatctgccatgcgatgtgcacctcagaactgctgagagggcagcgctccccagctccctggctccccacctgccagcccatggggcctgggggtagtgcaggccccagagagaccaagtgcaaaggagtacagctcattgcctctccttcctcctgcagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcga

SEQ ID NO: 257 - DNA, 846 bp, Homo sapiens
  ENST00000582761
ttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgccc

SEQ ID NO: 258 - DNA, 728 bp, Homo sapiens
  ENST00000577418
ggtgagaccaaagaacatctggtgatgtcacagtggacgtcagttcaccaactgggagacacaggccccgggaagaaaagcaacatgcccagcgtggcctgggagctggggcagagctggccttagaactcagcccctgacaattgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagaca

SEQ ID NO: 259 - DNA, 888 bp, Homo sapiens
  ENST00000583645
ctggttcctgtcagagttgctgagctgcagacaccgacctcaggtggtgcggaggggacatggcagagtggctggtgaagagagcagcctgccagcctttcaatcccagccctgccacttaggagccgtgggcccccggcgaggggggcggtcacttaactctccagcctgtttcctttactagccaatgggaatcgtgacagtacctgggtgcagacaggattgaaagtgaattcacacaatgttcttggtgcagagccaataagaggtggccaccggggtgtaggtgttctggggacctgtaatgtcctcacatgtcagcagttgctagtcacattggtctccactgctcacggacagtgaagaccacctggattccctgataaccagcaaggcccccacctagagccaggcagtaatgacctactgggctggatatgcacaccaaagatgatgtgtgcctcaaagcttgcaaacagtaggtgctcaagaaatgccactatgattagcaggactgggatctggagcgctcttcctgcaggagggcattgagcctaagtaacatttgtctttcctctctctgccgtcccccacactcgcctccagggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagt

SEQ ID NO: 260 - DNA, 407 bp, Homo sapiens
  ENST00000578679
ggtgtggggcagagcaatcggaaggaagggagccacccagaccatcccaggaggcaggtcacagggcccaaaaggtacagcacccccacccctccaccatcacaggcacaccagggccaagccgctaggaccctgggtctgacagctgggctcccttcccttgcagagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacat

SEQ ID NO: 261 - DNA, 546 bp, Homo sapiens
  ENST00000579409
ccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccggtaccgccacccaccccacctccagccttgggtcttaaccccctccccaggctgggcagccatgcggctgacctcggagcctggccctgccccgcacccttgccctgccctgccctgccctgcccatgctgtctccttgcttcccgctcagctcgctcagaagggccc

SEQ ID NO: 262 - DNA, 565 bp, Homo sapiens
  ENST00000582244
ctcctgagttgtggaggcagctctgtgggtgggaggcatctacacaggcacggctaggaagaggctcagacaatgctaagagctggggtgggggagctcaccctgatagctgtgggcagagttggggggccttggctctgctgtgcgcatgtgacttagcacacatcacatgtgatgtgcagaagggcctggggcccagtggcacaaggccctcaaccaactccgccccgggccacggcctcgctctgctccaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccg

SEQ ID NO: 263 - DNA, 5120 bp, Homo sapiens
  ENST00000428043
agaaggggcagagccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccggtaccgccacccaccccacctccagccttgggtcttaaccccctccccaggctgggcagccatgcggctgacctcggagcctggccctgccccgcacccttgccctgccctgccctgccctgcccatgctgtctccttgcttcccgctcagctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttaagggacatttttatgacttttatgtgtatgtttatgtagaaatttggaaaatacagaaaactgtaaagaaaataaaagccctttatatcaacgtcaagagataa

SEQ ID NO: 264 - DNA, 834 bp, Homo sapiens
  ENST00000534206
agggccgggcggggcgcgagcgagcgcgcgggctgggccggagccggcctggtcgccagcctaacccggcacagtgagcggagcgcctgggcggcggcggcggcggcgtgatggctccggccgcggaccgagagggctactggggccccacgacctccacgctggactggtgcgaggagaactactccgtgacctgggaatacagtgagtaacctgatcatgattatacctccaatgttcggtgcagttcagagtgttagagacggtctggaaaagcggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggcca

SEQ ID NO: 265 - DNA, 7378 bp, Homo sapiens
  ENST00000532485
gggcggggcgcgagcgagcgcgcgggctgggccggagccggcctggtcgccagcctaacccggcacagtgagcggagcgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcagttcagagtgttagagacggtctggaaaagcggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtgcccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctgctcatgtttcatcatatttgtagctctgcatcatttagcatttttatgactttttttgctttatataaattattgtaaaatccagattgtttttaccacatgatgacgtgactcaggattaaatcctgagctacagtttcaaaaggaaaatcatttttttcttatgcaaagatggtaaaacactgttgtcattttttccagtattcaataagtagcctttgtacaaatttaaaaccaaaaactattctgttgtttttcttcacctactagccttagtttttaaccaagtatccaaggatgtcaacttgacatccttcccttagcatgccaacaagccattagactgattcttccacctatttttatgaacctccaggaagaaaaacacttgccaaaacattaagagaactttgattctgccttaagagggtataaaactaaaccatttgaaggcacagcccataagactatacttgattttgccccaagattctgacttctggctacatttcacctgcagttacctgggctatcggccgtgatacattttttaattcatttgttttccaccattatatttttatacttttcagttagatatacttctgcataaagagtatatatacagtgtaggataaaggcatatcgtacatggcaatgctgttaaacatggtaagactgaggttctgcaggattaaagtcagattaagggtacagaaagcacaccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggaaaacttcatgttaactagagtgtacaaaaagtctgtttcctgctgagccaatagtgatttgtttgcatatcacctaatgtgaaaagtgctcatctgtgaactctacagcaaattatattttagaaaatactttgtgaggccgggcatggtggcagagcgagactccgtctcaaaaaaaaaaaaaaaaaaaaaaaagaaaagaaaagaaaatataaggatgtaaaagaagcaatttgcttgcacatctgaatatccttcttgtgcctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttttaaataatctacaaatgagaacccaaatagtagtgttttgtttgacagaagtaaatcaaatattatggtttaaatataatgcaaaatttcaggacagttaatttggacttcccttaccctaagagggtttttcttataataaggagaagaggtgtggttcaaagaaaattaagagacaaaaccttcaggtacataatgcatgaaaatctttaaatgcctgcaaaaattaagttctgttataataccagccaattctgaattagccaatgccctaaaagcatctaacaatttaaggttatcttatgagtcctatgaaaacaattatttgttgctaaatttgagttttagctaccaacgccatgtttacgtgacaagaaattgttttggccctgtggtttatgacgtgctgctggataagcatttatgtaaaactgagtatttcaaagagaaccatttacaattggaatttccacctgtgtggctgtttgcagacctacctctgtcttccattttgcatcctgtcagtgctataattagtttgatcactttgtcttgtttttcagtgtctacaattatagcttattcactatgttctaactatttaaaaataatgggccgggcgcggtggctcatgcctgtaatcccagcactttgggaggccgaggtgagcagatcacaaggtcaggagatcgagaccatcctggctaacacagtgaaaccccgtctctactaaaaatacaaaaaaattagtcgggcatggtggcgggcgcctgtagtcccagctactcgggaggctgaggcaggagaatggcgtgaacctgggaggcagagcttgcagtgagccaagattgtgccactgcactccagcctgggcaacagagcgagactctgtctcaaaaaaaaaaaaaaaaaaaaaaaaaaaagactaaaatttgatttaaagtagttaaacccctttatggaaggagctgcaaaatgaaaaaaaaaaaaaaaaggaatcatgtcatcttgacccagctgactggaaattttcaatactgtcttttaactgttgtactccagccagcctgggcaacagagtgagaccctgtctcaaaaaaaaaaaaaaaaaaaaaaaaaaaaagaattaggaaatacttgttaaaatatctaactacgtaattgctacatgggggagctgctggtgttgttgaggtccttgggagcattccactggacttcaccatttctccaaaattatcagcccagtcagcttcatatacccagatatggacacttctacacgtgaaattcaaactgaagataaaactctgactttggagtataaacttttgccttgagtatgaaaccttgacattgctgaaagaaaagtggaaactgtaagggacaacaagtttcaccaaggcacagtcttctctgataggccagcagagcagctaaggagaagacagatcattcaagaacttaagtcgtttgttagctacagcatttccattgctgtgatacacattcagccattttggaggaaagctaagcaggttctgaccacccattttcatgtactttaaataacaaatattatttctcaaggtcttcattttatcattaaattcagctaattactacctgatttcaaaggcagctagtgtagaagactggtcacaagaatttttttttaaatagaaaaccctaaaatgcaaatcaagaaattcagttacaggctgcaagtgacctaaaattcccctactctagctcagcagccatcagtcagtatagcatcagccacaggtcactgctctgcatacagttccttttcaacccttacaagacctgcttcattgctttaaaaatgtagtgttgatacttgaactgaatttagtcattggtaacttaaatattcacaaaattgtcataaagcttctgaaacatctggcaatgccagatctgtaatcatcacttttaaattgaatttgcagaattaactctaaagttgcagcaaccatatttattagagaaatctttaagcatatacatatggttccctataagcattcattcagagatcatctgtgcctaaaagaaaatgataaaaatgtgtcataatatcaaaggggtctagatcaggggttggtaaactacaacccatgggccaaattcaggctgcgttgtatggcctgcaaggtaagaatggttattttattttattttattctttatatatatatatatatatttatttatttttttgagacagagtctctctctgtcacccacgctggagtgcagtggcaggatctcaactcattgcaacctccgcctcccaaggttcaagcgattctcctgcctcagcctcccgagtagctgggactacaggcacatgccaccatgccaccatgcctggctgatttttgtatttttagtagagctgggttggccaggctggtcttgaactcctgacctcaagtgattcacctgccttggcctcccaaagtcctggaattacaggcgtgagctaccgtgcccagctggtttttacattttaaaaacgtttagagaaagaagaatatgcaacagaaactgtatgtagcctgcaaagcctaaaatgtttactctctggcttgggagtttgtctcccctgctctagactgtcagcaagtggtacagtggtacagtacagtggtactgcccaactgcacttctctgcaaggtgattctagtgtgcacttgtcagaatgaaaatatgttattcatttaagacatctcatgtctttgaatgtaatcacatgatttgtatttaatatttacatgacctaattattttttcacgtcagtttttctagattggcaatagcctgttgcaaagtgcctaaacctttgagaaaaattactatgagcaaggtccatgatttagttttcaatataaagggaattccattctatactgtaaaatccaaaaatgctagttgccctcagcttttgagttgacttccagaaagttgagatcttttgaccattttttctcatgtcatataaaatgtgccacatggtagttgtcaagctgtggtagtcatgtacactttttttcttttttttaactttctaaaaggaaaagttcaaagtcctttccacagttagtcttcgcttcttttggatttttctttttagagctaaattattcataccaatgaataagtgagtctgttctaagatataggggccattatctatttttgcttaatggactcatgtggcattgttcactatcatgcctttccatacttgtaatatttctgagtcacttattaatgtgaccaacagataaactgttcaagctaatacagcatttcctaacttcatagttgtcgcagatgtttgttctagtagcgattatttaataaacatacattgtactgaatcttactagcaactaactattttcaggtaatctcagtctgcttattcactttttccatttgatttgctaatgccacaatcatttttctagaaaatagtaggataatgtattttttcctgtctgctataatggagactatatttctgcattcattacctctcataggtgaaaatattaaattaaataatattgttttgaataaga

SEQ ID NO: 266 - DNA, 551 bp, Homo sapiens
  ENST00000530182
gccagcctaacccggcacagtgagcggagcgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcagttcagagtgttagagacggtctggaaaagcggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggagtctcactctgtcaccccggctgaagtgcaatggcacaatctcggctcattggaa

SEQ ID NO: 267 - DNA, 846 bp, Homo sapiens
  ENST00000525194
agcctaacccggcacagtgagcggagcgcctgggcggcggcggcggcggcgtgatggctccggccgcggaccgagagggctactggggccccacgacctccacgctggactggtgcgaggagaactactccgtgacctggtacatcgccgagttctgttccttcctaccatcctccctgaagagcaacctcaaggaatacagtgagtaacctgatcatgattatacctccaatgttcggtgcagttcagagtgttagagacggtctggaaaagcggtacattgcttcttatttagcactcacagaagtacttcagatttgagaaaagagcacataactatggctaaaagatgggatttgtaatctctggagttttttacttcaagtctgaggatccaaactgactaagtgaagtaaagaaataagcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggagtctcactctgtcaccccggctgaagtgcaatggcacaatctcggctcattggaacctccacctcccaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaa

SEQ ID NO: 268 - DNA, 2058 bp, Homo sapiens
  ENST00000525861
gcacagtgagcggagcgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcagttcagagtgttagagacggtctggaaaagcggtacattgcttcttatttagcactcacagatggagtctcactctgtcgccgaggctgaagtgcagtggcacaatctcggctcactgcaacctccatttcccaggtttacgcgatccttctgcctcagcctcccaagtagctgggactacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggagtctcactctgtcaccccggctgaagtgcaatggcacaatctcggctcattggaacctccacctcccaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtgcccagggaagtgtgttgcattaactaaagctaaaattatcagaatcctatttacataaagcatattaaaatatctgctcctt

SEQ ID NO: 269 - DNA, 1292 bp, Homo sapiens
  ENST00000531461
cacagtgagcggagcgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcagttcagagtgttagagacggtctggaaaagcggtacattgcttcttatttagcactcacagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctc

SEQ ID NO: 270 - DNA, 931 bp, Homo sapiens
  ENST00000530334
acagtgagcggagcgcctgggcggcggcggcggcggcgtgatggctccggccgcggaccgagagggctactggggccccacgacctccacgctggactggtgcgaggagaactactccgtgacctggtacatcgccgagttctgttccttcctaccatcctccctgaagagcaacctcaagttagtgagcacacatcaggcttcttttttggtcttgggactctgggctggcagaggtgacatccctgtcatatgaaggaagatgctcctttctctgaaggttattgacagggaatacagtgagtaacctgatcatgattatacctccaatgttcggtgcagttcagagtgttagagacggtctggaaaagcggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggtaagatatattttcattccttcagaaatatttttggaagcattttattaagtagagaattttataaacatatagaaatagtagtgccctgaaatgaatttttactattgttgacatttaaaagatatatacagtataataaag

SEQ ID NO: 271 - DNA, 1269 bp, Homo sapiens
  ENST00000526597
agtgagcggagcgcctgggcggcggcggcggcggcgtgatggctccggccgcggaccgagagggctactggggccccacgacctccacgctggactggtgcgaggagaactactccgtgacctgggaatacagtgagtaacctgatcatgattatacctccaatgttcggtgcagttcagagtgttagagacggtctggaaaagcggtacattgcttcttatttagcactcacagaagtacttcagatttgagaaaagagcacataactatggctaaaagatgggatttgtaatctctggagttttttacttcaagtctgaggatccaaactgactaagtgaagtaaagaaataagcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttctt

SEQ ID NO: 272 - DNA, 929 bp, Homo sapiens
  ENST00000533873
gagcggagcgcctgggcggcggcggcggcggcgtgatggctccggccgcggaccgagagggctactggggccccacgacctccacgctggactggtgcgaggagaactactccgtgacctggtacatcgccgagttcttggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgt

SEQ ID NO: 273 - DNA, 2093 bp, Homo sapiens
  ENST00000531352
agcggagcgcctgggcggcggcggcggcggcgtgatggctccggccgcggaccgagagggctactggggccccacgacctccacgctggactggtgcgaggagaactactccgtgacctggtacatcgccgagttctgttccttcctaccatcctccctgaagagcaacctcaaggaatacagtgagtaacctgatcatgattatacctccaatgttcggtgcagttcagagtgttagagacggtctggaaaagcggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtgcccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctg

SEQ ID NO: 274 - DNA, 3500 bp, Homo sapiens
  ENST00000278544
cgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcagttcagagtgttagagacggtctggaaaagcggtacattgcttcttatttagcactcacagaagtacttcagatttgagaaaagagcacataactatggctaaaagatgggatttgtaatctctggagttttttacttcaagtctgaggatccaaactgactaagtgaagtaaagaaataagcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtgcccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctgctcatgtttcatcatatttgtagctctgcatcatttagcatttttatgactttttttgctttatataaattattgtaaaatccagattgtttttaccacatgatgacgtgactcaggattaaatcctgagctacagtttcaaaaggaaaatcatttttttcttatgcaaagatggtaaaacactgttgtcattttttccagtattcaataagtagcctttgtacaaatttaaaaccaaaaactattctgttgtttttcttcacctactagccttagtttttaaccaagtatccaaggatgtcaacttgacatccttcccttagcatgccaacaagccattagactgattcttccacctatttttatgaacctccaggaagaaaaacacttgccaaaacattaagagaactttgattctgccttaagagggtataaaactaaaccatttgaaggcacagcccataagactatacttgattttgccccaagattctgacttctggctacatttcacctgcagttacctgggctatcggccgtgatacattttttaattcatttgttttccaccattatatttttatacttttcagttagatatacttctgcataaagagtatatatacagtgtaggataaaggcatatcgtacatggcaatgctgttaaacatggtaagactgaggttctgcaggattaaagtcagattaagggtacagaaagcacaccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggaaaacttcatgttaactagagtgtacaaaaagtctgtttcctgctgagccaatagtgatttgtttgcatatcacctaatgtgaaaagtgctcatctgtgaactctacagcaaattatattttagaaaatactttgtgaggccgggcatggtggcagagcgagactccgtctcaaaaaaaaaaaaaaaaaaaaaaaagaaaagaaaagaaaatataaggatgtaaaagaa

SEQ ID NO: 275 - DNA, 531 bp, Homo sapiens
  ENST00000527508
ggaatacagtgagtaacctgatcatgattatacctccaatgttcggtgcagttcagagtgttagagacggtctggaaaagcggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgaagagtattgctttgaactgcccctgagagctgaagattggccatgggtttatccatggcttagaggactgggttatacatcattgggtatatttttattgggatttttattttggaatatagataacatattttgt

SEQ ID NO: 276 - DNA, 560 bp, Homo sapiens
  ENST00000525325
tttaataaagttaagcagactcttaacttttcctcagaagttagcatgatttagtgatttaacacattttttaacattctattctttaaaatgtagtgaaggataataaatatttacatttaattgggaaggctattttggtaggcaaaatagacttcctttgccaaacaataatgattgtactaacctcattttccgttcctatttaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcct

SEQ ID NO: 277 - DNA, 567 bp, Homo sapiens
  ENST00000530921
catttacagcatggtttactgaatattttgagtagatgctcaaaaaaaaaacagttgctgaacaaatgaagcatatactcatgttgtttttgcttcgtacatgcagaagcactatggttacgtttgtcagtacgccagtttgcatgaattcaaaatgaatctgaaaagctttccccctcccacttttctttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaa

SEQ ID NO: 278 - DNA, 1906 bp, Homo sapiens
  ENST00000419336
cagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagcca

SEQ ID NO: 279 - DNA, 2172 bp, Homo sapiens
  ENST00000241069
gtcagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagcca

SEQ ID NO: 280 - DNA, 2159 bp, Homo sapiens
  ENST00000428317
tctactccgccgctgcaggtctttgggtcgcgtctgtcactgcgctctgtcgtcggtcggcgtctggcactggaacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagcca

SEQ ID NO: 281 - DNA, 2218 bp, Homo sapiens
  ENST00000412389
ctctcccctcatctttgccaacctgccccacctcctctgcagctgagcgataacccttgggccgacagtgccctaatctcctccctcctggcttctcgaccgacccttcaccctttccctttctttctcccagcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacag

SEQ ID NO: 282 - DNA, 1194 bp, Homo sapiens
  ENST00000426415
catgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcagacacgctcgacgaggcggagcgccagtggaaggccgagttccaccgctggagctcctacatggtgcactggaagaaccagttcgaccactacagcaagcaggatcgctgctcagacctgtgaccc

SEQ ID NO: 283 - DNA, 1496 bp, Homo sapiens
  ENST00000454485
catgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccagggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccc

SEQ ID NO: 284 - DNA, 1364 bp, Homo sapiens
  ENST00000440755
catgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcagggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccc

SEQ ID NO: 285 - DNA, 1305 bp, Homo sapiens
  ENST00000430554
catgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccgggacacgctcgacgaggcggagcgccagtggaaggccgagttccaccgctggagctcctacatggtgcactggaagaaccagttcgaccactacagcaagcaggatcgctgctcagacctgtgaccc

SEQ ID NO: 286 - DNA, 1472 bp, Homo sapiens
  ENST00000442452
catgaggcccccgcagtgtctgctgcacacgccttccctggcttccccactccttctcctcctcctctggctcctgggtggaggagtgggggctgagggccgggaggatgcagagctgctggtgacggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccc

SEQ ID NO: 287 - DNA, 2179 bp, Homo sapiens
  ENST00000411582
gaacatcggccgcctccagctcccggcgcggcccggcccggcccggctcggccgcctcagcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgcctcggaggctcccagcacctgcccaggcttcacccatggggaggctgctccgaggcccggcctccccctgcccctcctcctcctccaccagcttctcctcctcttcctctcccacctccggcggctgtgaacacggcctcttcccctacggccacaggggcccctcctctaatgagtggtcggaccgtggggaagggccccactcagggatctcagacctagtgctcccttcctcctcaaaccgagagactcacactggacagggcaggaggagggggccgtgcctcccacccttctcagggacccccacgcctttgttgtttgaatggaaatggaaaagccagtattcttttataaaattatcttttggaa

SEQ ID NO: 288 - DNA, 585 bp, Homo sapiens
  ENST00000441605
gtccctgcgtttgtctgtgcctgtcactgcatgaggtcgtccgtctgcgcgtgtctgtctccacgggcttctgtccgtctgtctgtcacacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctc

SEQ ID NO: 289 - DNA, 153 bp, Homo sapiens
  ENST00000445236
cctcgcccagcagccttgcgcgtgctaccacgctgtcctgccttctcagacgccgcctgccctgcagccatgaggcccccgcagtgtctgctgcacacgccttccctggcttccccactccttctcctcctcctctggctcctgggtggagga

SEQ ID NO: 290 - DNA, 480 bp, Homo sapiens
  ENST00000619863
tgcgccggccgctctcccacgcggggtctcgggggctcctgagccggccgcctccaggaagcaggcgccgcgcggtattgccgcatgcacctcggtcgtggggaccccgctgcagcagccctgtccacacgggtgaactcctggagggcggggcggggggcaatctgcgcgggtcaggcccctcggagcaggctgggggcgcccgagccaggccgctcccacctgccagccgcgtggccaatgaatgctaggcctggtgatgtcatgccccgaccggaccctggtgacgaaagtccgaagtcacccgtcagggaaccagcacagacccacccgcgggggttccagaagtttccactgccgccgcggagtgcggcctcgcccagcagccttgcgcgtgctaccacgctgtcctgccttctcagcctcgagcgagaccgacagggtgtccaagtgtgtccgtccgtctgtgaaagtcgtccc

SEQ ID NO: 291 - DNA, 2956 bp, Homo sapiens
  ENST00000302913
ggggtgtgtgcggggggccggaggcggcggctgtcagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgcctcggaggctcccagcacctgcccaggcttcacccatggggaggctgctccgaggcccggcctccccctgcccctcctcctcctccaccagcttctcctcctcttcctctcccacctccggcggctgtgaacacggcctcttcccctacggccacaggggcccctcctctaatgagtggtcggaccgtggggaagggccccactcagggatctcagacctagtgctcccttcctcctcaaaccgagagactcacactggacagggcaggaggagggggccgtgcctcccacccttctcagggacccccacgcctttgttgtttgaatggaaatggaaaagccagtattcttttataaaattatcttttggaacctgagcctgacattggggggaagtgggaggccccggacggggtagcaccccccattggggctataacggtcaaccatttctgtctcttctttttcccccaacctccccctcctgtcccctctgttcccgtcttccggtcattcttttctcctcctctctccttcctgctgtccttctccggccccgcctctgccctcatcctccctctcgtctttcgcacattctcctgatcctcttgccaccgtcccacgtggtcgcctgcatttctccgtgcgtcctccctgcactcatacccccccttcaacccgcccaaatgtccgatccccgaccttcctcgtgccgtcctcccctcccgcctcgctgggcgccctggccgcagacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagcc

SEQ ID NO: 292 - DNA, 2741 bp, Homo sapiens
  ENST00000216254
ctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtga

SEQ ID NO: 293 - DNA, 2811 bp, Homo sapiens
  ENST00000396512
ctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggtgaggaaggcggccaggcgacgtggcccctaccctgtgctgggcctgatgggtctccagttgggagtagaagcggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtga

SEQ ID NO: 294 - DNA, 699 bp, Homo sapiens
  ENST00000471094
gcctactggtgactcggctgcaggtgagcgagctcagggacctctgggttcacgggggcggggtgcctcctactgtgccggcggctgtgggcgaggcagggcgaggcgggcccaacctggggccaacttctcgtgtacctgtcccggttgtgggcccggcacccgtgcccgcttctctggtgccctaggtcaaggcgtccccggcacagtcagctttcctggccctgtccctgcctcgcaagaagcgtgggcccaagcagcggcggccgggtgaagagcggaggcacctctttcttctttttgaggacagcattgcctgctcccgtggggtgtgtttccattcctcaagactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcacc

SEQ ID NO: 295 - DNA, 624 bp, Homo sapiens
  ENST00000482208
tggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccaggtaaagctgggctcagtctgccgtcccaagggcccaagccagagaagtatgttccaggcctatggggggagggggtttgaggcccaggggggctgaggggaactggatgacatatccatcagctcttatgctcttcctcctttgttttgaaactgattttcattatgtcattatacgtgctcattttctgggtgagaagttaaaataatacctcctaaccacccaggtaaccagcattttaagtgcgacatgtttctttccacattgtcttctgggtgtgtactcaagcatctctattcccataaactctcatacagaa

SEQ ID NO: 296 - DNA, 644 bp, Homo sapiens
  ENST00000478010
aggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggtgaggaaggcggccaggcgacgtggcccctaccctgtgctgggcctgatgggtctccagttgggagtagaagcggtgaatggccttcacttgagaatctgtctgttccatttggggacttgggatagacagaggtagaaggaaaattggagacagcattagagattgtctagtccacatcctcattaaacagatgaagagattga

SEQ ID NO: 297 - DNA, 330 bp, Homo sapiens
  ENST00000481310
cctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactgcagccaccctgagctggggccctgagctctgatccccatggcctcccctcaccggcccaggtttttacccagggcctcaagggatgagtcggcccgctgtcaccacatctctctgagtgggaggagaagcaatgcagctccctggtgtgaagatgc

SEQ ID NO: 298 - DNA, 747 bp, Homo sapiens
  ENST00000466237
ggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtggacgccctggcatgccagtcactggcatctgctgctgctgggtacagtgtggctgtgaagagcatggagcctggagccagatggcctgggcttgaatcctggctctgccacctaacagccactaacagctgagtgaccctgagcaaactacttcactgtctatgtgtgggttccccatctgtaaaacaggagtcatgatcgtactgacacctttgaaggtggtgttgggcctactgctgctatcaccaatgagaaaaataaataaaaaataaagttgtctggagaagtgacaa

SEQ ID NO: 299 - DNA, 2875 bp, Homo sapiens
  ENST00000481208
agcgccgccgcctccgcgcctcccttcagcctgcccgcagcttcccgcctctggctgggctcggggacctcggaggcctgtttctgagcccctccccgcggactcgctccccggacgcccccagcgggctcctctggcctcggccctgcacgccgccggggcggagcctcccatcctttggggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccgtgttggacaagtggtgaatatcaaggccaaggtgaaccgggccttcaactccagcatggaggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccagccggctctgccgtgcccaccctacgctgaaggccattgaaatgttccacttccgaggcccgtcccaggtcggcgaccgtctggtgctcaaagccatcgtgaacaatgccttcaaacatagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgatggtgagcggcggtaccgagaggccagtgccagaaagaagatccgcctggacaggaagtacatcgtgtcctgtaagcagacagaggtgcccctctccgtcccctgggaccctagcaaccaggtgtacctgagctacaataacgtctcctccttgaagatgcttgtggccaaggacaactgggtgctgtcctcggagatcagtcaggtccgcctgtacactctggaggatgacaagttcctctccttccacatggagatggtggtgcatgtggatgcagcccaggccttcctgctgctctcggacctgcgtcagaggccagagtgggacaagcactaccggagcgtggagctagtgcagcaggtagacgaggacgacgccatctaccacgtcaccagccctgccctcggaggtcacacaaagccccaggacttcgtgatcctggcctcgaggcggaagccttgtgacaatggggacccctatgtcatcgcgctgaggtcggtcacgctgcccacacaccgagagacgccagagtacagacgcggagagaccctctgctcaggcttctgcctctggcgcgagggggaccagctgaccaaggtatcctactacaaccaggccaccccaggtgttctcaactatgtgaccaccaacgtggccggcctctcctctgagttctacaccaccttcaaggcttgtgagcagtttctcttggacaaccggaatgatctggcccccagcctccagaccctctagatgccctcagtggccacatcatgcccactcccactccatcctgtccccaaggactcacatacagtgcctggagaaagccaaagacctttatttcttcctgcctccccgtgggaagcctccgccctgaggtccgctggcccaccacccctgggtgctcagtttctaccaacatgagccagcaagtccttgtggtagccctggggtagcctgtagtagactcgggtcctgtccacagccctagctgccagcaatgctgtcctcacagaggcatagtcgcccccagctgggttgtgctccactgtgacggtggcccggggggaggatgccagcagcctgcctatggctccagctgtgctgtggcccagcagcatggcctgcatctggaaggacacaggttgccagagcccctggcacaactctagcatatctgtgagcagctgttccctgtagccactgcccagcacctcctcaggccagcctggtgccacagtcacgtgggggaagacctcagccacagctgtaagcagctctctgccagccacatggccggggaccgaaaaactcccgtgggagattttggccccaacccacacaggccaatgcaagaggccaaggctggagaggcgtgccagcaaggccagggatggccggagggctgcgggctccgctatttgcaaatggatgccccagtgtccgggatgtgtggccagctgctgcaggcaggactccagcgtcaggatgttgccacttggagtatgaacaatgggcacggggttttcagccacagttccctcgaggccagtgttcagcaggatcatgccttctgtgtctggaagaggcggcagaggcaacagtgtttaggatttgggttatcataaggtgttaagagtcccttgttaaaggggcagtgggagttatggggtcatcaaggaccttgcctctctggaatctgtcaacccagttttgggctccaggtggatgggttgctttataaatgtgcctggtgcatgag

SEQ ID NO: 300 - DNA, 2450 bp, Homo sapiens
  ENST00000498228
caggcttcatttggagtcaggcctggctgttgctcaggtgaccagcttgtgtctctgggagggcgctgctttccccggccacccggcgcgatgatccagaatgtcggaaatcacctgcgacggctctctttggaaggagaaatcgcagaacccctgggctggtttattatcagcagcaatctccaaacaagccccaggggctgtcagatcccccacgggctggctgtgtagagtggaatcaccttcagcaagtgtcggcctctggaattctattcgggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccgcggagaggcacgctggctgcccctgtgtcacagcttccatggatgacatctattttgagcacaccattagtgttggacaagtggtgaatatcaaggccaaggtgaaccgggccttcaactccagcatggaggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccaggtgagggcagggtgtgctgcctctgcctcccctcctttctcctcctcctccccttggctacctccctctggaggggaaaccccagcttggggttggcattcaaggcttcagaagcttggctgttctgaatcagagaaatgaatttttgtgaactgaccattccttgttctactaaaaaagctagcatcttttacatgggaaacaccaggtctcttggcctggcactagatcctccccttgatctggccctacctgcactccttctagtatctatgttcccttcacatcaagccttctagtatctatgttcgcttcacatcaaaccatttgctgttctctgttcccatcctccactttcccagcccctgcctttgctcctgatgtagcctcctgccgtgcttcccctactcttctttgtctgctaatatcctgcccacttcctccataaagccatctctgactgttcccttcttctaaggggtgaaaattgttttctctcctctaacatctgtttctgtccggggcttgttctaccctaaatatcagggtattttttatagttatggtaactgaccttcactaattgacactctcacacctccaagactttgctcttgctgttccctctaccaggagtgcctttcccaacccatgccctttccagccaggtggattcctccttattctttagagcctggcttaaatggcccctcctccagtttaacctgtgggagacagtgcataagcaatgctgttttgggcaggcctggctatgagtgcagtaagatcctggaggagcctgatggtcagggaaggctgcctgaaggaagagcacttcagctgggacttgaatgccaagtagctttgggtaaggggagggcttctggatagtgggaacagcagctaccaaggtgtaaaagttggaaggaaaatgggaaaggggtttacccaaagccctgctttcttctgtcccctcaaacttggcttctttccagccatgcatagacctcagtattctaaactatgaaatgggactttagttctgtgcctctgggcagaactgccactgggttgggtggcagtgggtgggtcagaatgtgtagttccaggctgcgtctggggatgggaccagggtagaaggctggcccaagctggcctagcatggtggctcacacctgtaatcccagcgctttgggaggctgaggccacttaggccagaagttcaagaccagcctgggaacaaggtaaaacctcatctctactaaaaatacaaaaattagccaggtgtggtggtgcgtgcctgtagtctcagctacttgggaggctgaggcaggagagtcacttgaacccgggaggcggaggttgcagtgagccgagattgcaccactgcattccagcctgggcaacagagtgaaaccctgtctcaaaaaaaaaaaaaaaaaa

SEQ ID NO: 301 - DNA, 3082 bp, Homo sapiens
  ENST00000343744
atttggagtcaggcctggctgttgctcaggtgaccagcttgtgtctctgggagggcgctgctttccccggccacccggcgcgatgatccagaatgtcggaaatcacctgcgacggggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccgcggagaggcacgctggctgcccctgtgtcacagcttccatggatgacatctattttgagcacaccattagtgttggacaagtggtgaatatcaaggccaaggtgaaccgggccttcaactccagcatggaggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccagccggctctgccgtgcccaccctacgctgaaggccattgaaatgttccacttccgaggcccgtcccaggtcggcgaccgtctggtgctcaaagccatcgtgaacaatgccttcaaacatagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgatggtgagcggcggtaccgagaggccagtgccagaaagaagatccgcctggacaggaagtacatcgtgtcctgtaagcagacagaggtgcccctctccgtcccctgggaccctagcaaccaggtgtacctgagctacaataacgtctcctccttgaagatgcttgtggccaaggacaactgggtgctgtcctcggagatcagtcaggtccgcctgtacactctggaggatgacaagttcctctccttccacatggagatggtggtgcatgtggatgcagcccaggccttcctgctgctctcggacctgcgtcagaggccagagtgggacaagcactaccggagcgtggagctagtgcagcaggtagacgaggacgacgccatctaccacgtcaccagccctgccctcggaggtcacacaaagccccaggacttcgtgatcctggcctcgaggcggaagccttgtgacaatggggacccctatgtcatcgcgctgaggtcggtcacgctgcccacacaccgagagacgccagagtacagacgcggagagaccctctgctcaggcttctgcctctggcgcgagggggaccagctgaccaaggtatcctactacaaccaggccaccccaggtgttctcaactatgtgaccaccaacgtggccggcctctcctctgagttctacaccaccttcaaggcttgtgagcagtttctcttggacaaccggaatgatctggcccccagcctccagaccctctagatgccctcagtggccacatcatgcccactcccactccatcctgtccccaaggactcacatacagtgcctggagaaagccaaagacctttatttcttcctgcctccccgtgggaagcctccgccctgaggtccgctggcccaccacccctgggtgctcagtttctaccaacatgagccagcaagtccttgtggtagccctggggtagcctgtagtagactcgggtcctgtccacagccctagctgccagcaatgctgtcctcacagaggcatagtcgcccccagctgggttgtgctccactgtgacggtggcccggggggaggatgccagcagcctgcctatggctccagctgtgctgtggcccagcagcatggcctgcatctggaaggacacaggttgccagagcccctggcacaactctagcatatctgtgagcagctgttccctgtagccactgcccagcacctcctcaggccagcctggtgccacagtcacgtgggggaagacctcagccacagctgtaagcagctctctgccagccacatggccggggaccgaaaaactcccgtgggagattttggccccaacccacacaggccaatgcaagaggccaaggctggagaggcgtgccagcaaggccagggatggccggagggctgcgggctccgctatttgcaaatggatgccccagtgtccgggatgtgtggccagctgctgcaggcaggactccagcgtcaggatgttgccacttggagtatgaacaatgggcacggggttttcagccacagttccctcgaggccagtgttcagcaggatcatgccttctgtgtctggaagaggcggcagaggcaacagtgtttaggatttgggttatcataaggtgttaagagtcccttgttaaaggggcagtgggagttatggggtcatcaaggaccttgcctctctggaatctgtcaacccagttttgggctccaggtggatgggttgctttataaatgtgcctggtgcatgagaaactcttgtttcagctcttggcctttacccatgactcagcctgggggctggtgccggccttgcctgcagcaatgtagctgaggactggtctgaaggccaggagccctgtgctcttgacatcactgtactccctctccctccccgcaaccctgccccaccttgcatccagggtatggtgtaaataaacctgtgttgccatggc

SEQ ID NO: 302 - DNA, 6369 bp, Homo sapiens
  ENST00000371316
atttggagtcaggcctggctgttgctcaggtgaccagcttgtgtctctgggagggcgctgctttccccggccacccggcgcgatgatccagaatgtcggaaatcacctgcgacggggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccgcggagaggcacgctggctgcccctgtgtcacagcttccatggatgacatctattttgagcacaccattagtgttggacaagtggtgaatatcaaggccaaggtgaaccgggccttcaactccagcatggaggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccagccggctctgccgtgcccaccctacgctgaaggccattgaaatgttccacttccgaggcccgtcccaggtcggcgaccgtctggtgctcaaagccatcgtgaacaatgccttcaaacatagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgatggtgagcggcggtaccgagaggccagtgccagaaagaagatccgcctggacaggaagtacatcgtgtcctgtaagcagacagaggtgcccctctccgtcccctgggaccctagcaaccaggtgtacctgagctacaataacgtctcctccttgaagatgcttgtggccaaggacaactgggtgctgtcctcggagatcagtcaggtccgcctgtacactctggaggatgacaagttcctctccttccacatggagatggtggtgcatgtggatgcagcccaggccttcctgctgctctcggacctgcgtcagaggccagagtgggacaagcactaccggagcgtggagctagtgcagcaggtagacgaggacgacgccatctaccacgtcaccagccctgccctcggaggtcacacaaagccccaggacttcgtgatcctggcctcgaggcggaagccttgtgacaatggggacccctatgtcatcgcgctgaggtcggtcacgctgcccacacaccgagagacgccagagtacagacgcggagagaccctctgctcaggcttctgcctctggcgcgagggggaccagctgaccaagtgctgctgggttagggtctccctgactgagctggtctcggcaagtggcttctattcctgggggctcgaatccaggtcaaagggtcgcaggagcgacggttggaatggaaaactagctggaggacacctgagtactcttaaagcaatccccgtggccaaaatcaacagccgatttggataccttcaagacacctgaaaccttatcatgagccagatgccaaggaagagactctgggaggatccagaggaccccctggttgcagccacgtagagactgacgctgaggaggactccaactatcatgagcaacacccgtcgaacacagccaccccgctaagaacagatcaagaagctgtcacagatggcggaagaaaacctgaggaaagcgggacaaccagtcacaatgaataatttaatggtagctatgatagcagttatcaccactgccgtgagtattccttcaataagggctggtaataatgcctggatgcaatcattctatgacacagttacacatgctttctgatctcagtatttaccataataaatcggctcctataattgaggcataccaccctcaaaaacctatttgtaaacaggattggacccagttagaaaaaatgaacgtacttatttaggaagattgctttgcagaataggcagagatgctgcacaacgattcctatggaatcattactaattggtcccccaaggggatgtttagcttgaattgcacctctcagtctgcatgccacggtcacactatgttcagatgatctgaacaaaacagtcagatggtagaaatgttaagtacggcaaaagttcctattatctggaaccatggcggtatagtggcacctcaacctcaaataatatggcccgctctaggagctaaacataaggatttgtaaaaactattaaatgctcttaataagatcaaaatttgggaaagaataaaagagtatctagaaggacactctacaaacttgtttttggatatagcaaaattaaaagaacaaatatgtaaagcatcccgggcaacctgaccttaatgccaggaaccagagtgcttaaaggagctgcagaaaaattagcagctagtaacccatttaaatgggtaaaaacacttggaagctctgtgatttcaatgatgactatgctttttaatctgttgtttgcctttgtatagtctgcagatgcggatcccgactcctgcgagagtctctttgcaaatcgaagaagggagacatgttgggagcaagccccccagagtctggccataaactggccccaaaactggccataagcaaaacctctgcagcactaaaacatgtccataatggccctaacgcccaatctggaaggttgtgggtttatgggaatgagagcaaggaacacctggcctgcccagggcggaaaaccgcttaaaggcattcttaagccacaaacaaaagcatgagcgatctgtgtcttacgggtgtgttcctgctgcaattaattcagcccatccctttgtttcccataagggatacttttagttaatttaatatctatagaaacaatgctaatgactggtttgctgttaaatgaaggggtgggttgcccctccacacctgtgggtgtttctcgttaggtggaacgagagacttggaaaagagacacagagacaaagtatagagaaagaaaagtgggcccaggggaccagcattcagcatacagaggatccacactggcaccggcctctgagttcccttagtatttattgatcattatcgagcatggcaggataataggataatagtggagagaaggtcagaaggtaaacacatgaacaaaggtctctgcatcataaacaaggtaaagaattaagtgctgtgctttagatatgtatacacataaacatctcaatgccttaaagagcagtattgctgcccgcatgtcatacctacagccctaaggcggttttcccctatctcagtagatggaagtatattccatgtaaagtaaatcggctttacacccagacattccattgcccagagacgagcaggagacagaagccttcctcttatctcaactgcaaagaggtgttccttcctcttttactaatcctcctcagcacagaccctttatgggtgtcgggctgggggatggtcaggtctttcccttcccacgaggccatatttcagactatcacatggggagaaaccttggacaatacctggctttcctaggcagaggtccctgcggcctttgcagtattttgcgtctctgggtacttgagattagggagtggtttgagattagggagtggtgatgactcttaaggagcatgctgccttcaagcatttgtttaacaaagcacatcttgcacagcccttaatccatttaaccctgagttgacacagcacatgtttcagggagcacagggttgggggtaaggttacagattaacggcatctcaaggcagaagaatttttcttaatacagaacaaaatggagtctcctatgtctacttctttctacacagacacagtaacaatctgatctctcttttccccacagttaataaatatgtgggtaaatctctgttgggggctctcagctctgaaggctgtgagacccctgattttctacttcacacctctatatttttgtgtgtgtgtctttaattcctctagcgctgctgagttagtgaccgagctggtctcggcagaggtgggcgggtcttttgagttcaggagttcaagagcagcctggccaacatggtgaaaccccttctctactaaaaatatgaaaattatccgggcatggtggtgtgcctctgtactttcagctactcaggaagctgaggcacaagaattgctggaacatgggaggtggaggctgcagtgagctgagatcatgccactgcactccagcccaggcaatagagtaagactctgtctcaaaacaaaaagagttttaggccaggtgtggtggctcacgcctgtaatcccagcactttgggaggctgaggtgggcagatcacctgaggtcaggagttcgagaccagtctggccaacatggcgaaaccccatctctctctactaaaaatacaaaatttagccaggtgtggtggtgggtgcctgtaatcacagctgcttgggaggctgaggcaggagaattggttgaacccaggaggcagaggttacagtgagcagagatcgtgccactgcattccagccggggtaagagagcgagactctgcctcaaaaaaagaaggcttagtgtgcaactcatcagagttgcacagggcagagaaagaatgggaaaaaaacaatttctagaaaacttttcgaattttctgatcaacaccaaatattccaaataggaaaaatacaaaaaaatccatacctatatgtggcataatatgattgtagagcaccaaagtaaaagatcttattttttattaaaattaaaaaaaaattaaaatagagggtctcactatgctgcccaggctggtcttgaactcctggcttcaagctatcctcccaccatggcatcctaaagtgctgggattgcaggcatgagctgctgcatctggcccaaagtaaaagatcttagaagcggccagaaaaaatagatttgggctgggcatgaatagattgatcaccaaaaaggtggcagactaacttctcgacagaatccacagaagccagaaggcagtggaacattagctttgatgtactaaaataaaataccacgctaggctcctacatacagtgaaaatgttttgagaatgagaattataattttttggcaaacaaaactaaaggagtttacaactaagaaactcttttgtgagacagccttgctctgttgcccaggctggagtgcagtgacgaaatctcagctcactgcaacctcggcctcccgggttcaggcaattcttgtgtctcagccttccaagtagctgggattacagatgtgcgccaccaggcccagctactttttatatttttagtggagatggggtttcactgtgttggccaggctggtctcaaactcctgacttcaagtgatctgcccgccttggcctgctaaagtgctgggattacaggcatgagcgactgtgcctctccagtccctgtgtttttttttgtttttggaggttttatttgtttgtttttagagacactttcactgtgttgcccaggcctgtctgttggcctcaagtgatcctcctgccttggatctcccaaagtgctgggattacaggtgtgaaccactgtgctcagcccattttttatttgtttcttgaaggaaggtagcagtattaattaattttggactttgctcactaaagtttgaatgttaagaatagatgtatacagtctggatgcagtggtgcatgcttgtaattttagcactttgggaggctgaagcgggaggatcgcttgggctcaagagtttgagaccagcctgggcaacatggtgaaaccttgtctctacaaaaaaattttaaaaaattagccagacatgatggcatgcacctataatcccagctacttgggaggctgaggtgggaggattgcttgagtccagggaggtcgaggctgcagtgagccatgatcacaccactgcactccagcctgggtgacagagtgatactgtctc

SEQ ID NO: 303 - DNA, 515 bp, Homo sapiens
  ENST00000479837
gagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccagccggctctgccgtgcccaccctacgctgaaggccattgaaatgttccacttccgaggcccgtcccaggtcggcgaccgtctggtgctcaaagccatcgtgaacaatgccttcaaacataggtgagggtctgggatgggtgcggccacgtccattcagggctgagggctcttcctgaccctagaaaggaccctacttcaaactgtccaggagccctttgccctgcagacagggtctaaatccctgcctggctgatgggttcctctgaaattcagctctgattttcccttcttgggagccttccctggctcccagtcctgcccacccctggctgggtcagggacccctcctctgggatcccccag

SEQ ID NO: 304 - DNA, 1403 bp, Homo sapiens
  ENST00000608083
gccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaccc

SEQ ID NO: 305 - DNA, 1813 bp, Homo sapiens
  ENST00000377842
aggatgcaggcttggacctgctggagtccttgctggcctgtgaccttcctcccctgtctacatttcagggagctctagaaggcggcagtggggccagacctggctttggctgagaccctggagaaagactagggggtcttgtgccctgtcagagaaggcagagcctcatagccgcttccctgaggccgctcagcagcggcccctctgccttcctgatctcctggcatggcagccagaagagctcacagaattacttcttctgtaattatttataaagcaaggtttccatgacgaccggtttctggtagacgctctggattggcgaggcagcctcttcctggccagattgggcagctcaggaagctgggggtggggggtgctccccaccaagcccggtgtggcagggagctgggacagtcctgggtcaggcaaggactctgtgatgcttccctgctccctcgcctttctctgcatctgatcctgggatgtcctagccaccatggctttccagctgagcaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 306 - DNA, 1432 bp, Homo sapiens
  ENST00000377845
gagttccatttggctgcagcttctggagggagccgacaggagacgtggggagacgatgctcctgcttcggagaagcttgtcactaaacgtcctcagaaaggaagtcgacagggcctgttttggggagaaggccaaacagatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 307 - DNA, 1614 bp, Homo sapiens
  ENST00000377855
cggtcctaggaggagcaggagcctggtgctttctatcagggagggatcacaccggctcactgctgagccggccaggcagacacaggcttgggctctgctgggcatcatacttgtcactgggtaaacagtttgcccacttaccgcaggatgaagctgcttgccagggctctccggctctgtgagtttgggaggcaggcatcttccaggaggctggtggctggccagggatgtgtggggccccggcgagggtgctgcgctcccgtccaggtggttgggcccagggctgatctcccaccctgtggagcctgcattactggaaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 308 - DNA, 1472 bp, Homo sapiens
  ENST00000377860
gccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaagctcacgtaatgcctgctggcgctgaccacacagctccttcctcctctcccagcactggcacgaagtgctccctgctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 309 - DNA, 1564 bp, Homo sapiens
  ENST00000418124
gccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaagctccttagctggggcctgacccatggcctgccctcctcccggggtgcgtcttgtgactgcgggcgctttgcatgggactctgtaccttacagctcacgtaatgcctgctggcgctgaccacacagctccttcctcctctcccagcactggcacgaagtgctccctgctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 310 - DNA, 2429 bp, Homo sapiens
  ENST00000361521
gccggagttgcgtgggttttaatttaaagatgtaagtacaaatctatgtgcattgtagaaaattcggaaaaggtccaactgcctagcaagtaaaaagctgtcattccagcacgtggggggtgaccgcttctcccttcttgggtgttttttggtggattttttttggtgaccccgactggcctagactccattcaagggcacatcttgtgcagtaaaacacgcatgtttcagggctcctcactgcaacacgtgcacctccaggctggcgctcagcgctcccagtaaaagctgcaggcggcggtgtagatagtcgccggcctttcctcctccccacctcgtgacgctttgtgctgcggaagcaaaggcccgttccattccccgtgtcttcccagcagccgccaccaatgctcctttctaggaaacagccttccattctctcttagggccgatcttagcgagagccgcgatgcgggcgactggtgccggggtgggttgggggcgggggtgggaatcaggccccactgccaggagcccgggccgcgccttccgctctgacctcatccggccgcccaggcactgggcgcggcagcgaatcggcggcgcgggcggccgggaacgcccagcacaaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 311 - DNA, 868 bp, Homo sapiens
  ENST00000473466
tctgatttggggaaagggagaaggggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaagg

SEQ ID NO: 312 - DNA, 748 bp, Homo sapiens
  ENST00000481175
gctctgtacaagtttctgttgaacatgtatttcttctgggtatctgcctaggagtggaattgctaggttatacggtccctctgtgtttatcctcttgcgaaacttcaaactgtttccaaagtacctgcacctttggctcccactggcagtggaggagggttccagtttcccccacatcctcgccagcacgtgctgttctgtgacttcaggattgcagccatcccagttgatattgtaacaaaacttgcccagcagggtgagatatctgtagaggacaggaaaagggctgttttgttagtggcttggcatatcagccatggtcgtttttttcaaaatctcctgaggaagccccatgtagcgcgtgagccacagcacgtgcggccgagcaccctgcacccctgctggctgcggcccttgctggtggctagtgggaggggagggctcgagttgtaacttgtttccagggtgtgaaataatctcctctgcctccgtgtctcatctgccgcatgtccctttctccgcaggtgtgaccatgaagctcatggatgaggtcgccgggatcgtggctgcacgccactgcaagaccaacatcgtcacagcttccgtggacgccattaattttcatgacaagatcagaaaagctcacgtaatgcctgctggcgctgaccacacagctccttcctcctctcccagcactggcacgaagtgctccctgctgcgtcatcaccatctcgggacgcatgacctt

SEQ ID NO: 313 - DNA, 1804 bp, Homo sapiens
  ENST00000545482
caaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 314 - DNA, 6357 bp, Homo sapiens
  ENST00000258873
aaaccacaaagaaaaggaaagttttaattctgagaaacttcactgaggagcaattttttttgagcttctaaaaatagagaggaaatgagcctctttgggtcactctagttgccgcctcccctgccccatgcccacccccactgctcactcaaggctagcctctctcagtgggtgactgagctgtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacagaactgtcaacaaggacctgattttttttgtcaattgagcaggtgggaccagtgcagagagtagtgggcatttaactcacaggactgtgcacagcgggcatgcgagtgaccattagtgccctggaataaacaaaggtgcaggatggggtcaagtggcgcattctcataaaagcagccagctctacgttagcctgtcgccaccagaccaccccacttccattctgaatacgggaagcagccattctcagtagcaagctgagccaaaatgaccgaaggcatctgaacaggaaacaggtagagaaagcaaacatctcagttttggaattctttattactttgaacccaagagccactgataactggcacaatccaatgaaacagaggaagcagcagcttaaacaaaggaaaatacatttaagattataagtctgggggggcggttacaagcttaaaaagtgacccagacagggatatcattgctaaaaaaaaaaaaatccccttgtgacctgggtacattttgcaaagccacaggtttgcaatgttacacaagggccaaaggaggccatgagttgtctttggttgtggggacagagggtaactgttcatgaaaatagtgagtgtctgaagattaagaaaatcatgctgcagcagaggagaagggagaggaagacaggaagggaaaggagatgcctgagggtcaaaagctgagcccaagcctaagcccaagctcaagctcaagccccagcatggcataattttgtgaattaactcaggctgagttgcctccagtctttggaatgtcatcttatactggtactgctgaggcagagggcagtaattggtgctttgggataggagaaggggcagttgctgaaatacaaaattaatagcatcccaagttcctcaattgcagccaaaatacatgtgttcgggcctttcggcagtatcgcccccagaactacctgctgtagtgtggtccattcccagacagcaacatgcaagaataagtttacaatacactcagcccttctggcttcagatcaggggctcagaggctgtgacaactcatgatgctgaaaatgtatccagtgaaaatgaagtactagctctctgcttcattaaaagctcttggaaagaatattaaatctcaagacaacaaaataattgaacacacaatacatttgtgtctttgtatccaatatattacctttgtcttattaacaaaaattatatctctcattatatatttcttggatctgaagtttttattcacactcagtaatttctgtaaaggacaaatctgtctctattttccatatcatttagaaatataccacattcactctttttgatgtgaactttcccaggaaaattctcttgtgcccatttagttttagaagagtgtcattttgtgctattatgtcaatatcctgttttatttccattatgtttttcaaaaaccgaagaaaataaggtttttcttaaaaagttagacattttctcttgttaattctgtatcctgttatttacagctgaagagaaactattttaacttaagtgtaaaatggtttagaatagcaaatgatacagtccactcagagtttacaaaaaaaacatttaccaggtagacacttaataaataaaacaagcacttggaaaaagttctttgaaaacagacctagggacatccacctgcatcttttgcacagattttgttaagaaaaggccagatctaaaaatgtactgtcaagaaacaagcaaaccaatgcatacatacgtaggtattctaaacagaggttcatgtggtgtccatttagagtgactgatgtaaatgccagttgtagaagtgttaatctaaatcttttactcggcgacagatttcctctgtgaagtctgagcattttgcattgcctcccaaatcttttgtcaagctctgagaaaaggaaaaagcaaaaataaaagatgtatccgcaaactaaactaaaccaaggagattttaaagccctcagtgagatgccacctgggcaagttactcggctgctctttcatttagttcctcatttcaaagtgaggaaccactccaccaccatctacccagcccaggaggatcgggatccaatctcatagtgtatacaacagcactctgcaaagaataaggtgctcttgatgcaaagggaggcagggagctttaccaaaattttccctttgttcacacaatagaccctaacccagattagttggtcatggatatttaaataaaagcgaatctaaataagaagtttcataaaaatccttgggaaatatgtctcaggaatagacctgagacatattttgatctatttttgtttttattattattttttttttagatggagtctcactctgttgcccaggctggagtgcagtggcacgatcccagctcaccacaacctctgcctcctgggttcaagcgattctcctgcctcagcgtcctgaatagctggaattacaagtgcatgccaccatacccaactaatttttgtatctgatctatttttggaggctgggacacaaatacgaaagaaatatttaaatcattaactcttttttttttttttaagagacggggtctcactatgtggcccaggctggtcttgaactcagaggctaaggtgatcctcctgcctcagcctatagctgcaactacaggcatgcaccaccacacctgcctaaatcattaactcttaaacctccctctttaggaaagaaagcctcccatacaactgatctgttctaccagcttatcctttctttcctgcatacagaccccaatatatttaattctctttatctttccatcctacacaataaaagggcccactatgtaattcaggcacctctctactgggctgtagattataacttcccaaatataactttaaagaataagaaaatcatatgacctccaatgtgactatcaggctgttaaaaacaagcctgaatttcttgtattttggccacacgatataatttcaaattacagaatttttttaaaagaagggaccaactttgaagatattacgctaagtgaaataagccagactcaaaggacaaatactgtatgattccacttacatgaggtacctagagtagtcaaattcatagagacaggaagcagaatggcaggtgtcagaggatgggagggggaagggaaagttactgtttaacgggtgcagagtctcagtttgagaaaatgaaactggtctggagatgactgatggtgatggttacattacaatgtgaatgtacttaacattattgaactgtatacctaaatacggctaaaatggcaaattttatgttatgcatatttttcacaatttttgttaaaaaggacctcaaattagg

SEQ ID NO: 315 - DNA, 2257 bp, Homo sapiens
  ENST00000560124
gtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacag

SEQ ID NO: 316 - DNA, 2462 bp, Homo sapiens
  ENST00000560817
ggcaacccgctccggtcaccttccacgctgtgaaagctttattcttttgctctttgcaataaatcttgctactgctcagtctttgggtccacgctgcttttatgagctgtaacactcactggaaagtctgcagcttcattcctgaagccagcaagaccgcgagccccccgggggaggaatgaacaactccagagacgccactttaagagctgtaacactcaccgtgaaggtctgcagcttcactcctgagccagcgagaccacgaacccaccagaaggaagaaactccgaacacatccgaacgtcagaaggaacaaactccagacgcgcccccttaagagctgtaacactcaccgcgagggtctgcggcgtcagtcttgaagtcagtgagaccaagaacccaccaattcgggacacatagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaa

SEQ ID NO: 317 - DNA, 675 bp, Homo sapiens
  ENST00000560183
ctgggactggcagaagggggccatggatgagatgtctgagcaggctgagtcgtggatgacaagccgaggagagggaaacttgggtgagcatttgtcgtcggggtgctgccaccagcccccaagcaggtgtgagttgctttggagggcctgccactgcttcttggctcccagaaagggggcatctccagctgtgctgaggcttccgggttgtggttgaggcttgggttgtggttcagctggggcacctggactacattctgtgccgggggcctggccttgcctccccagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgg

SEQ ID NO: 318 - DNA, 584 bp, Homo sapiens
  ENST00000558301
aaacagtatgtgccacccttgcgtgcaggtgtgtgtgggtgcccgttggagcatgtgtgtgccaccggcatgcctggctggtaagaggggacccctgggccccagatgcccctgacccaacaggcctgcctcttctggtgtgaacaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctg

SEQ ID NO: 319 - DNA, 1474 bp, Homo sapiens
  ENST00000559707
acccccactgctcactcaaggctagcctctctcagtgggtgactgagctgtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctgtaagtcccctgtaaa

SEQ ID NO: 320 - DNA, 734 bp, Homo sapiens
  ENST00000558728
cagagacctttactaagccgactcacacagggagatggggtactttttagaaggtgacatttctcttactgaaacctgatctatttttcctgtcaatgcagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtg

SEQ ID NO: 321 - DNA, 895 bp, Homo sapiens
  ENST00000557935
tagttgccgcctcccctgccccatgcccacccccactgctcactcaaggctagcctctctcagtgggtgactgagctgtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagagatggagtcttgctacattgcccaggctggccttgaactcctggcctgaagcgatcttcccaccttggccttccaaagtgctgggatgaacaggctggagccactacacctggcccactactacagccttatactaaatcttgaaatcagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacg

SEQ ID NO: 322 - DNA, 559 bp, Homo sapiens
  ENST00000559114
agatttcttcttcaagaaagctgggaagaagagaggccagagatagagagacagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgt

SEQ ID NO: 323 - DNA, 925 bp, Homo sapiens
  ENST00000559241
atgccttagctgagggagcagaggggttgctgagccctgtgcctgccaggtgcaagaaggaggaagggcggtccggtggagccgggcctctctggggctgctgtggctctcccggggggactccgtgacatgttctctgaggttctggctctctcctgggcaagctcacagattgcagccaccccccaggcaccatgccagaggtgctcctgctcaggtctgccagctccatcctgaggactgcgttcttaagcagatggctgccaggtgggcctaggtgtgttcacaaacttagttttgttcggaacctgcagtgccgacaaggagtgaggctgaatgtgagaagcagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataa

SEQ ID NO: 324 - DNA, 569 bp, Homo sapiens
  ENST00000558130
gtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagcaggcccacagtgtggccatcctcggcttcaactccccggagtggttcttctcggcagtgggcacagtatttgcaggtggcatcgtcactgg

SEQ ID NO: 325 - DNA, 600 bp, Homo sapiens
  ENST00000558828
ggcaacccgctccggtcaccttccacgctgtgaaagctttattcttttgctctttgcaataaatcttgctactgctcagtctttgggtccacgctgcttttatgagctgtaacactcactggaaagtctgcagcttcattcctgaagccagcaagaccgcgagccccccgggggaggaatgaacaactccagagacgccactttaagagctgtaacactcaccgtgaaggtctgcagcttcactcctgagccagcgagaccacgaacccaccagaaggaagaaactccgaacacatccgaacgtcagaaggaacaaactccagacgcgcccccttaagagctgtaacactcaccgcgagggtctgcggcgtcagtcttgaagtcagtgagaccaagaacccaccaattcgggacacatagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacac

SEQ ID NO: 326 - DNA, 573 bp, Homo sapiens
  ENST00000558793
ggcaacccgctccggtcaccttccacgctgtgaaagctttattcttttgctctttgcaataaatcttgctactgctcagtctttgggtccacgctgcttttatgagctgtaacactcactggaaagtctgcagcttcattcctgaagccagcaagaccgcgagccccccgggggaggaatgaacaactccagagacgccactttaagagctgtaacactcaccgtgaaggtctgcagcttcactcctgagccagcgagaccacgaacccaccagaaggaagaaactccgaacacatccgaacgtcagaaggaacaaactccagacgcgcccccttaagagctgtaacactcaccgcgagggtctgcggcgtcagtcttgaagtcagtgagaccaagaacccaccaattcgggacacataggttcttaagcagatggctgccaggtgggcctaggtgtgttcacaaacttagttttgttcggaacctgcagtgccgacaaggagtgaggctgaatgtgagaagcagctcactgactgacaggcagccactctccaaagagtccctgaaccatgc

SEQ ID NO: 327 - DNA, 600 bp, Homo sapiens
  ENST00000559713
aaatgagcctctttgggtcactctagttgccgcctcccctgccccatgcccacccccactgctcactcaaggctagcctctctcagtgggtgactgagctgtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagggccgtggagagaatgggagaagccaacacaaggcactcggcatagtacatgtgcttagtaaggaaccaaaccaaacaaaaagacgagcttctcgcccagccctgggggacccagtggcaggaactgtctcccaaggctctgccaaggatgacggccaaaaaactgcctctcctgccgcccacccttcttatgtaagagccacacaggtgggcaactgggtcccgtgccatataggtcagaggtatctggggctacacctcaacagcagccctagggcaggctggggcgggtccccactcatgcccaaccccactgcctcatcacccggaacctggggcatccac

SEQ ID NO: 328 - DNA, 1130 bp, Homo sapiens
  ENST00000575584
gcatttggggctgaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccggtgaattggggctctccagaacagcagaaaaatgaagtcatttcccctttaagcaacaaaagatgaaatgcattgctgattccacacatagagagcgaatcagagaggagcactcccattggcagccaggctgacctgagcataatcctggtccctaccttaatgttcaaggtccctcattcagtcagtgctggatttgtcagcagcttttctgtgcttcatttgcttctataatgcggtggtagttattagagctaccattcagagtacatgaaataaccaatatggtgcatttagcacatagcaggtggtcagttaataataaactagtggccatgtattgggtacttagtgtatcgc

SEQ ID NO: 329 - DNA, 2796 bp, Homo sapiens
  ENST00000331849
gcatttggggctgaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcctgaggcactgtctgaccggaggagaggccctcaaccctgacgtgagggagaagtggaaacaccagactggtgtggagctgtacgaaggctatggccagtctgaaacggttgtcatctgtgccaatccaaaaggcatgaaaatcaagtctggatccatggggaaggcgtccccaccctacgatgtgcagattgtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgaaaagggtgactgctccatacaaataccccaggaaggtggcctttgtttcagaactgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaactaaaaaaaaaaaagaaaaaattaacaattaacatccaaacaacaaggaaatgattaacaaaattgtagtagattaactcaattacatatgatgtagccactaaaatatttgagagcagtttagtatgtcttgggaaaagtgtaagctatattaattttaaaaatcagagcaaaaatattcatactggagaatcccaactctgaaaaataaagggaaaactgtggttaattgtaatcctcctggagattgaggagggagggagagaaaataatggatggtagtttttcttcttcctttttccattacatttctgtattttccaagtttttgtacgaagcacatacaactattttaatgaaaaagttatgttaaagaaagca

SEQ ID NO: 330 - DNA, 856 bp, Homo sapiens
  ENST00000575070
gaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggtgaagcctgttctgtcctagagtccatctggggcatctgaggctgccctcatgtaccacaatgagactcaaggctccaagcatgttgatgaggaaatttggacctgggaattttgctagttctaaaatgtaaactgttggcatttgagacttaggaaaaaattctgagtcagtgttgtgagccttagacatgcttgttccttctctgaagtgtcctgcattcttgagcccaaatcacacagtgagacagttatgtcccttccgattcccttccagttgttcatcaactgaaggaggaagttttgttttgctgctactctgtctttgatgtttttctctcactgtcacgcccttctcttctaaataaggaaagaaggccgggcgcggtggctcatgaccataatcccagcactttgggacaccgagaagggcagatcacctgaggtcaggagttcgagaccaccctcaccaacatggtgaaactccgtctctactaaaaataaaataaaaaaaaatt

SEQ ID NO: 331 - DNA, 771 bp, Homo sapiens
  ENST00000570305
tcagtttcctggtctgcaaaagggttataatgatagtacctaccccatgaggtggttgcagattacccaagccagagctttcagcacagcacctcacatgtggtatttatgaaacggtagtcatattgttgttacacatattattggtgctactaactgtttttaccgtggtagtgccacctagtgtatttacgttttacagggaggcttctacagagcacaactgcatgaggacaaagagtcgagacccgctggccatctactttaccagcggaaccaccggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcctgaggcactgtctgaccggaggagaggccctcaaccctgacgtgagggagaagtggaaacaccagactggtgtggagctgtacgaaggctatggccagtctgaaacggttgtcatctgtgccaatccaaaaggcatgaaaatcaagtctggatccatggggaaggcgtccccac

SEQ ID NO: 332 - DNA, 480 bp, Homo sapiens
  ENST00000574748
catattgttgttacacatattattggtgctactaactgtttttaccgtggtagtgccacctagtgtatttacgttttacagggaggcttctacagagcacaactgcatgaggacaaagagtcgagacccgctggccatctactttaccagcggaaccaccggggcccccaagatggtcgagcactcccagagcagctacggactgggttttgtggccagcggaagactctctccaaattcccgataaccaccctctgctgtgtcccaaccatctttcggctgcttgtgcaggaggatctgaccaggtaccagtttcagagcctgaggcactgtctgaccggaggagaggccctcaaccctgacgtgagggagaagtggaaacaccagactggtgtggagctgtacgaaggctatggccagtctgaaacggttgtcatctgtgccaatccaaaaggcatgaaaatcaagtctggatccatg

SEQ ID NO: 333 - DNA, 457 bp, Homo sapiens
  ENST00000573920
cacaactgcatgaggacaaagagtcgagacccgctggccatctactttaccagcggaaccaccggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatgtaccagtttcagagcctgaggcactgtctgaccggaggagaggccctcaaccctgacgtgagggagaagtggaaacaccagactggtgtggagctgtacgaaggctatggccagtctgaaacggttgtcatctgtgccaatccaaaaggcatgaaaatcaagtctggatccatg

SEQ ID NO: 334 - DNA, 569 bp, Homo sapiens
  ENST00000577024
ggggaaggcgtccccaccctacgatgtgcagattgtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaaggtcaagctgtctgcactttcctccttcctttgaaatttcatgggggttgagggaagcccacttggaagagtttgtttttcccttccagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgaaaagggtgactgctccatacaaataccccaggaag

SEQ ID NO: 335 - DNA, 4767 bp, Homo sapiens
  ENST00000484396
tttccccttctgtccatggtgtatctggtggggacaccgtccagccccattacagagagtttatgagaaaatgtccagcctcatgtatcctcacgggcttggtcatagcactcaagccagctctgcagccgccacgcgtgtgtgccagagtgtgctctggagtgtgcaggctgtgtgctgcgctgggactctttggacgaatctgacctgtggttcccactgcacagcgacatgctgggggaatgcagaatgagggactagaatggcctttaccaaggccacgctttgtttcgagtctgccagcttcttggtggctgggtctgggaaggggcgggagcacctaggtgttgcaatgccaggtccatccaggcacactgcctggcctggcgtgacctggacacacactgaccccatgccagggcactgctgggcagactggcttctcctgccctgcccagtggcttggggtcaggcttgccctcccgctgggaggccaccctgtgtcacagtgtgtcccagatgtcaccttcctccctgcacttctatgtgccgttattccattatttacttaaatgctctctttaaattgacgcattgcaagattgagaatttgtttcagtgctttacaaacagcattttcagttgccatggaaaggctatgctggtaaggctgggatgtgggagagagctggtagggacccctgcccggtgacatgtccagatgtgatcaggagggtcagagaggacggagacgaggacagtttctcaggtgtgactagggtaacttagtgcccccctgaggttacctcgctctggcaggagcctgggcccctcctctgaggactcctgcatttcacatctctgggctgggggtccacagggcactgacgtgtcctgggatttgaaagccccatctatgtctgagtccagtggctgagccagtactccctggggccactgagaggggtccgggcatggtccactgtgtctggggattcagcagcccctggattgaactccataaagcaagtgcaagatcaaggaaaggacaatggaagtgacctttagacaaacgtttgggcatcacaatcactgtctttcatagggtggcctagccttaggtctgttggggtggtgttggggcatggtctgctgtggacgctgctgcccagggcacgttctgcgtgtgtggagctattgcaagtctggtgttgccaggcttcttaatgtctgccagatgtgtggggataatttgtctatcatgtgtatgatgatgtgcattttcctgatttctaatgaatttgagtatccattctataattatgaagagctgatgaacagctcttggttggctctaaagctgcctgtgaatatcgtatatttgtccccactctctctgttttgcagcagctctgaaaaagggcagcccctggaccttgtctaggacctagacccagcaagcctctggtgctgctggccaggctcttgtctctcttgtctccagtgtcctgagccttgcctgcctcgtcctggctcttaactggctcctccacccatgtggaaggtttcctccctccagctccatcctcagaactcaacagtccaggcccacttctgatcccatatcaacgaccaagatgagaaaaacggtgttctttccctcaaagatctaacagcctagtggggtggcagcagggggactgacagctgttcccacatagcatgtgccataaactagattcatgggtggagtcaggaaaggcttcacagagcaggaggtggctgaactgagtcttgagggatgaataggagttcgccacatggatataggaaggcctttcaggcaaaggctgtaggtctttacagatcatagcttgttcagaaaaccaatcatccattcatgcacttaacaaccatgtgttgagcacctcctgtgttccaggcatggttctagatgctggggacacagcagtgagtgagaaggtctctgaccccatagaggggtcaagagtagaggagagagacagacaaagagcaagaaagatgatcaccaaggaaacgacacagtcagttaggtgctacatgccagggaagaatgggtgaaggtggcatggggctggggcagatgagcagtaggagagccacacatatatagaagcttcgagggagagacagagcacctcacaggccagtggggacgggcaggctatcagggatggcaccgggatgagcaactccttatatggacaacaatcaaattagatccctcttcacagtgtgaactcttcctggaacatgccagggtactgaaaaacgaaagctagtatttatgctataatgtgggctggcccgtgctgcccagcagaactctcagctgcctctcagctgtctgtgttgtccagggtggcagcctctggctgctcatggtgctgaatggcacttgaagtgtggctcatgcagccagggagctgctgatttaattgaactgaaatagctaccctggcccatggcaccatgttgcacacacacccccaaaggctggtggtgcccatttgctgtgcatctgtgcaccttctcatggaagtctcattccatcaaaccacattatgggttatttcacagatgtgtacacagagaggggaggtcccatgtcccaggtcacacgcagccagtcagcattagagctgagatgccaagctctcagccacacatgtgcactcacctggaacatctgtggagctgttagaatcgctgccacttttcatgaaactgaagtgcatctttgggtttgcaactaaagaaaccagctgctacaatgtcactaacataggattcaaaagcccttcggatttctggcagtctgtgcatagcaccctgcctcgggagttggctccttgtctagtatttaatacatccccaaacttggctttattttcagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcggtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattttc

SEQ ID NO: 336 - DNA, 3680 bp, Homo sapiens
  ENST00000323482
ggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcggtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattttc

SEQ ID NO: 337 - DNA, 2244 bp, Homo sapiens
  ENST00000376726
aaaaggaaaacgaggcaccgagaagttaaggaacttgctcaaggtcacagagtttgaactcaggctacagatgctgcagcaactggagaaagtcctcatcgccccatatcacccaccaccgacccccagcaggacgtgacccccgccaggacggaggccggcagctggggggctggagcatgggacccagaacacggactcaggcttgcgcagcctcctggcttctaggcgggagcctagaaaggcgccagcccctttcgcgtgctgctgagactccaggggtggggttcactctcaggggcgcacaaaggcatgaaaaccttggcttcagcctctgagatgcggaactgaccgacctattgtcttgggacccaccagtgcgcttgggtgcaccagcccccttaacgttggtgccggctccctcccggctcctccccatcccagagggtcccctcgccccaggccctgagcctgcgtcctggggtcctgggccgcacgtgcctctggcagctcgaagaagctgtcggggcttgcaggagagcgtgcaaactgaaaccaaaacaggccgactcgaggaacatccgggtgggaccgcagactcaccggagcgcagcgcctgggccagggcctgggaccctgctccgccccgcgctcccctgcaccccttccccacgctgctcccctcttcctaagcggccccccctctcccgggcagcagaagaaggggtgggacccgggcgggctccgggagggggccctggaggaatggatggtggcggaagggcggagcaggggcggggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagtccctggttgcagatgccgtgtggcccataggccagcagcattcttctgccctggatcctcgggccccactggacaactgagcggccccccaggtggcccctgcacactggagtgtgcttggctctgaagacccaagctgctgcagctgcccctcgccacggtgggcccagctccatctgcctgcgaacaaagccccttctgagaaggaacttgaggctgctgcccctggagtagttcttcagtaaaagatgaaaaccctctgttgggggtcgggggctaaggagctaactggacacctggaggtccggcagggagggcccagccatggcactccccgaagggccagtttctctccatcagtctctcaggtgtgcctggaccctggggcaggcaggttgtgtgccacgccccctcggctggacgctgcccgtgggagcactgagtgtgtgctaagtagcggttcggtctgtgagcggggctggagccctgtggagacgtgtggttaaacataaaccatgtgagaattctcaggaccacagccagcctgtggaagctaaggacagcttcaggtccatgacactgaaatggccctggcaaagtacttattactctgtctctaaaaataaacaggggccggtcgcagtggctcatgccggtaatcccagcactttgggatggtgaggatcacttgaggacggtgggtggatcgcttgaggtcaggagtttgagaccaacctggccaacatggtgaaaccccgtctctactaaaaatacaaaaattagttgggtgtggtgatgtgcgcctgtagtcccagctacttgggaggctgaagcaggagaactgcttgaaactgggaggtggatgttgcagtgagccaagattgtgccactgcactccatcctgggtgacagagtcagactccatctcaaaaat

SEQ ID NO: 338 - DNA, 2438 bp, Homo sapiens
  ENST00000432802
ggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatactccaaatagttgggttcttcagggaagctattagaaactcaggtgacttgttagagcactaacttggtcagagccaaatcctggcaaacgctgcctgaccttcactctgtggttggggcggtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattttctc

SEQ ID NO: 339 - DNA, 3509 bp, Homo sapiens
  ENST00000537502
agccctttccttgactaccctttgaacagaggagagctatgcaaacacgctgcgagcggccttgagagcccgaggagggtctgctttctgggcccctgcagagggcaggggtcgcgggctggtggtctgccccgcccagagagaaagggccttggcttcccctcattcttcgttctgtgttagctctttttattgcaaataattaattaaagtcagtacagcaagagtgggaaagtggttaatgcaattgccaggtccagattcagagggatgaggcgccgaaaggaaagacaaccttgggatcgcttccacttcctccacttcgcaccgcatggccgggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcggtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattttctc

SEQ ID NO: 340 - DNA, 3833 bp, Homo sapiens
  ENST00000616449
gttactgtactctcagcaggatgttcttttgccttgcccatcgttcagtttaatcctctagaaagaaaatttttagaggtacatcggactaaatcattttcttctgagtacaccatttccaaatggccgcccagggtcctaaatccggcggctgcggagagggactagagggtgtcctcctctgcagagccgtaggactcgagcgccttcatcactggacgctggagccaggaaggaaacccacacactcagggacaggtataaccccacaggggtgcaccagtgaggccccgatcgcagcggaggactccatccctgagcttgtgagggcgtcctggggaggaagcgaacactttccccgttcaagtcagagagcaggactcactgggtggcaggtcagaagttgaattttaacccgacctgcgctttgtccccgcgccttccgcagcctgggcgccgcggtggcaccgagctgggagaggacacgagaggctggcgcgggagaagccgagagttgctatcgaccgggagctgccggcggcgggagcagacgcgaccctcgccgctttcgatctcgaagccgcggagagccgatctcggctgctggggctcggctccccgcgctctgccttgccctttcggcagagggcagctccctgcctgctgcagccccgccactgtgcgcccggcagcccaggggtgcgcccagcccgccccccgagtggccgccgggactccagcagttggaccgaccctcgccctccggcgcctggacaaacttccttcctcccgggcccctgcgccaagcaagctgacaggcggctccctcgccggtctcctctgggctctggccgggcgagcttgctctctgcccctctccaaccccgagcccctggcgcctatagccgtccccgcgcagcggctccaacaaagccagaggaccggagacgacccggcgaggggctgggagtggcagcggggaccccagagccagaaggaggcgtcccctcggcggggcgagtacagtgggaaggggcagcgggaacgtagcggggagagaaaggggaagaaagtgttctgttctcggcgcgaacgccttcctggctcgtcctcgttccccttctcctcctgcctgagcgcgtcccatgtcccgttgggaattggcaggcggggaagggaggaggggagaggggacgcggtggcctggcgagcgagccgctcccttacctctgtccagggtgagcggctggaccactgtcaatgtcgccatgtctgccgtgggagccgaagtgacgctcggcttcagcatcagcaaccgctcgtagtgagaaaaaaaggaggagattgggggcgggggtggagagggaagacggaaaggagggggaggagggggaaggaaggaaggtggtggtggtggagaagaaagcttgggtgggttggtagccagatggagacgcaactgttccgcggcggcagatcttcagttgcggtgcggagctgagcaggtatccgagagcgactgcatcgccgggctctgggagggaaggctctgccctagaactttgctattccacccccaggagcgctgggtgggtgtagctggcgggttgcttcctttcaactttccactctaataaaatggtcagaatatacgtgtgtgcatgcgggtgcgtgtgtgtataaggggaagagagaggatggaaaggggatatggggaagggagtgggagatgagttttctcagattaagagaaattgccaatccaataatcccatcccctttagagagaaaatgcttccattatcagaaatgtttgggatgtaattacatttgcagttaatttctgttgaagtttttcggaatgttgacctataacggcatataaagataactgactaaaggccagcgttccatcagtagatgttcatttaggacctgagtatattgcctggagaaaaaaaaaaaaaaaggcaaacctcttaaaagtgcttcaaaataaaaaacgtgtaggtaagtttctatcgctaagtttttctttttcaagccactgttaatacattaccaattcagtaaatgtagcttagaaacaagtacagtgttcagattttctccgaattttttacataccacatcctgtaaacatgccccactccccctcacccacccagcaacaaaaactttgctcttaatgtccaaactgattttggttgtctatgactacgtttgaaaaatatgtacctagcacttttcatgttgatttctaaccagtggttcagagatgccacttatcgattgattaacatatatgccaggaattgagatagaagagttacattgccttgtgccacgccttgatttaggagttcaatttagtctccgacttcctgtagcctgtaatctagtgggagatggtgttattaaaaacctgactttagagtcagttgatcaggattaaattacgagagccttcaaatactggctgtgacctcttcgccccaataaaaaggctactttcactatcttgtcatagtagggattcatttcctgactacgaaatcaagaaacataaagaaaccttctataagctgaataggggtgactgtgggtgcaggattggaaatgacaaagctgcctccatcttgtttcctgtgacagagctgaattgtttgggctaacaataaactctaaaaggcagatactgttttatagcaaaatatttgcatataattgatgccattttcttctgattacagataggatttctgaaggtctttttcattttatagtctacaattgaattttaaaaaacaacatttcaccaatgtgggaaagccaaagatgattggccatatatagacttaacagaccctaagaacaaacctaaaatagtagttcgatatgtttatttttatttagtatttaagaaagaatgctgatcttgacatttgagtcttagtcatgtactcttcggaagtcacacaatctctcactgatcctgtttcctcctctgtcatacaatggaaataatatcattcaatgtcacagagatctgtcatatgaggaaactaattctaccttgcaatctcacagagttttatgagggtctaatggagtcatacatgtgactgtgctttgaaaacagtaaagaatatacaaatttatttatacaagcatacatcccctggaaccgtgtggtaagctctgtgctaggtgctaaccatgcaaagattaatgagatggccccctttctgcccagtcttgcttgggagacagtgagcaaaccataagcttctgtgcagtactctaagcactattaaaaggaagtgccctcggtggccagaggttgcaaaaacaactttggttttttaccgttattcacatgccctgaattaagcaacagaaagaagttgagatgagcgcaatgataccagagtgtgttacaagcttttgcacaaagttattaaacctcactcggtaactgaggataaaagaacatacaaatcccttgacttctaatgtagttattttacaacatcctttattagggaatatgtatttaagcagcttgattcatcagcccaaaagtcataaattgtacccattccaacacaaatccctgattgtggtgtcagtgaaggtagagttttctttgtctttttgtttcctaatgcatcctcaggactaaacatttcatagcatatttctggacttctgccttgagcttcctatttgaaatttgctctgtcattctttctctgtgttgactctgtagggttgttgttgtttttaaatcaagattaaaagagaaattaaaaggaagcataaatcaccat

SEQ ID NO: 341 - DNA, 534 bp, Homo sapiens
  ENST00000549175
aaggtggtggtggtggagaagaaagcttgggtgggttggtagccagatggagacgcaactgttccgcggcggcagatcttcagttgcggtgcggagctgagcagagacagagactgactgtgatgcccaggcttatctctaactcgtggcctcaagcaatcctcttgcctcaggctcccaaagcacttggattaccggataagctgtagacatgtttttaaaggtggatatgtgcctgtaggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggat

SEQ ID NO: 342 - DNA, 9254 bp, Homo sapiens
  ENST00000548058
ctttctttttacattttcccagtttcctcttttgattcatctttacttacttcctatttttgttttttgtttatttgtttgttttgttttctcattagaaaagccacagaaactccaagcaggcaaattagaagggaggcaatgcaacaagtcctatctgttctctgtctagatcacatgcggagtctggtcagcaggtgaatccgcatcccagtggggtcaccttccctgtgacctgtcaatcaccccaagaagcacttcccaatttgtctggcacaacctccttccactcctcctaccctctcagtggtcaggaaatcccggagcagtccttgccctggagctgcttgtgtttttagtaaccagggactgagctgattttgaaaaatcaatcaatcaataaataacaatcaaagagccttgcctcaacgcaccgagttgctggtttcctgcaggtcagaggcgatgccacctccaccaacgaccttccaaagattaaaccagccgtgtacaaactgctggattgaaaattgagagatgggccgttggcctcctcctaggagtacttgtgtgttgaaatcggaaggacgttctggagtttgagcgcgatttttcccggaaggctgcggggttggaagtgcatgttggggtttggatctcgtgcagcagcgcaactaacctgctgcaacggcgctgtgacacccctgtcccggggcccccactttagcctgttgcttctctggtcgctccaggtcggtttttcccggcgactctagtgtggcttccaaacttctgggctctgggctcacttcggaatttgcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctggggcaaagctgccgagcagatcagctggtacaagccctggaccaaaacgctggagaacaaacactcgccctctaccaggtggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtagaaattacttgcaaaatgaaatgtgaattgtaaaacttggcctaaacaaatctaatgaaaacatgtgaaagacctgtgccttttttttggtttgaccctgttagcattgttattagttatctataacatggcttattgaatgtcatctactgctttaggaaaaacgtatctagtgtattatttttaaaattgtacctcccaagaagaacactttaattgaaagcaacactaatatagagccacttcctgaaaccaagaatctgtagttttgatccaaaatctaaaacttaaagtcagaaaataattaaaatttttcttgtagaaattttagatattttctagtattctttagatgctcacattgttttaaataaaatagatgaaatgggaagtttaggtaatcatctagacagatgaaattattatctaggtaggagggcttttctatacattttctgagggaaagcagaacaccggggttatagctataccttcaggtcttttgttacttaggcaaggaaaaccacatgtctgacctggttcagcatgtaatccgagcactttgggaggctgaggcaggcggatcacttgaggtcagcagtttgagacgagcctggccaacatggtgaaaccctgtagctactgaaaatacaaaaataagccaggcgtggtggcgggaggctgaggcaaggagaatcacttgaatacaagaggcagaggttgcagtgagccaagttcccccactgtactccagcctgggtgacagagtaagactccatctcaaaacaacaaaaacaacaaaaaaaccacatgcctggcggagaacaaagagatcatttagtccaatctcttcatggagatgagggctcctgggagcccctcttcatgtctcaggttcttagttgactatgtttatccaaatgattccagattcctgtggaaacaaggaatcgatgtacaaatggggtagggtggcaaggaaaactcttaagagagaaacatcaaggttttcacattaggttaaagacaagaaggtttctaggcaggtagtgtaatgtctaggtgattttgaagtgaacttaagccactaggtttgagggacaaaggacagtagaaaatggtgaagactgcagatcacctgctatacctcaaggagcagcggacccagcagaatatggcccaaaaaggaggcaggtctcctgttgcaagagcctctgtttttttaaagagaaaacaaagaatcctggtttttatgtgaaatctctaattttaaaataataactcattaaaaatattgtaatgtccaaaagtatctttccatttaacttctaaaaatctcttaaatgttttttttaaataattgtaaagtgagtttttgttaagcttataggaatgggccagttaactaaggtagacagatgtaggaaattaaatatttgatttacttagggatctatatgacatcagttatcaaagaatacattttaacccaaaagtataccatgctcattgtatctttgatcgttcttcaagtatttctcaatcttttaatctatcaggaacattactatcaagagcagattgttgtaacataatactcaggatacatgaaatgtatgtgagagataaatagataatagaaagtttattgttataaaaatgacctacaacttatataaaaaaattctgaaaatgttgactttttttggactgaagactgcaaaataaatggcttctcaaagtaaattcctatttacttaaattgccttcttgattgttacacctggaaaaatatattcatctactttttccttttaattatgttagtagactgaattaaaccagctacatagacactctctcatttgaagctgttgggatccttgagttgcctctttcattggtacgttttatccattgtcacaactgtggtcttcattaataactcattttaatgtcttaggagtagaatgtgtttccttattttttttcaaataagagtcagttaatttgaaatggcaaattatttacctgaatgtgtatcattgttcatttgcaaggtttaagctcaggcagatccaataattaggtaaaggttgcatctttggtcctcttgcacattttttctggtaatcaaatctgaagcgacatctcagcaagcagacttgggttattttccactaggatgggaatggaaaacagtgctggagactggggaagtggctatttcctgtgtctcactggggaattgcaagatcaaagaatgttgttacttttatgtgatgaaaaaatagggcaagaaagatatacctgaatcatcagactgcttaaaatttgggaggaaaaaattctattttactactaaccataaatcacttttgctagatagtactttaaagattctgaattaaatgtatctttaaaaacaacaatataatattactaaaaaatgcagacatacttaaacttgctagaataaattctgtgaggtcttcgtttggtattttcataggatttcttactgttaagttattggaaaatgaaaatataaagtgctttcagaagttatagtattttccaattcattgaattactttgcttgtgaaaatatattaaacatatttaaatgagacctatcctacatttaaaaaccagttttgtttatataaaattgtatttgaaaggtcctgaacattaaaaatgtgaaaatttataatgttgatgatcaaaagtaacgtgttgagactctgagcttaatccattaaatggattttagaatctagtagaagttatctttcttataaattaaaacatattttatgcttcttttttgagggaaatacctggatcttttgcatcactatatgttagtgtctattatagatgattaatctttctaacttgatctttaaaagaaagaaattgattttagtgattgagtgttatataatagtagatacaaatctagttatggcattataatgtcgtagttcctatattctatttcatttctatgaatcaagatgcccatgtttagatgagcttagaaagctacttctcattgttcctactcaggccacatttttagaaaaaaattttaagatcactcccataagcaagtttagatctccctcttgtggcagactcaattttgaagctaaatatttgggtcacccaaagaacacatttcctgatagtttaagtaaattgtcgagccttatgtgactagaaaacaaagcttaaacagagaactggaattattattttttttattgacaatggaaagggtttctgttatcattaccttttgactgaatctgttaaataaaaatagacatcaaaacaaatgtaatgtacgtgcaaacatagcaaattaaaatacagaaaagaaattactaatgacaggtcttgcgcttaataagatcaagcagcagaaaatcagcagttagataaatggtattattaaataggctttactttgaatctcccatataaacaaagaataaacaacagtaacaccaccaaataaagccacagggaagagattactcttctatacttttatacactatatatgttaatcattctgtctttcatttatttcctctgataaaactgacttcagggaagtcgcaacaaggccatctcggctaaaagcttataacattagacatgagtctggctaatgccctgttacattgacaaaagggaaaggtatcttgggtttcgttttctctagtggaaatgagcctcagactctgcggtggttgacattcactgtccagtactggctggcatttcaagatatttgaatgaacatgtggttcttagtaaagaagtttttttatctttttttttttcttggtccacaggtaacaagagaagattatggttttttaatataaatttttaaataattgcttttgacccttgtaaacagcttggctttgttttgtattgaaaaggagatcaagccatcacagtgctatttctaaagatataggacatccctgattgcctttaaagctctatttttggctccggttccaggttaaatcattcttttttacatgatcagaggcaggttgttcagctttaagtattgacagacttgaaggagaaacacgttgaagcatgaaacatgcttcaaggaaacatattgatttgactattaacaatccaaaaactgtaaaaatggtggaatggtaaaatacaaacagtacttggaattgtcaaatgtttgcactcgagactccatgaaccatatattttattttttaaaaaatcatatttatatccatttacataagacttacacatttaaaaagaaatgcacggtaatacataaatgcctagtatattacaataaaacatgaaaaacaactggcttcatttcataaaagcatctgttgtacagagtttatgatgtagatgatgtttattattcaaatgacttaagcattttattacaatttgtagtaaactaatcaaatgtaatatctgactccccccaaaaatcacatttttcagcttttaataagtcatgacgtcattatttccttagaattcagttttcacaaaggttttcactgctcgtcttcttagatggtagtgcactttaggtagagtagactgaaaagacgccatctaaaatatacaatggatagcattagttcactgaaaagtcccagactgggaaatctcattctactcctctgtggtgtacctccacgcagcctgcttactcctgtcctagaagatcatgagaaggaaatcatctaggatgtagccaacagccgtatgtaattaacatttgcttttctccaatttggtgcaggggagcttaacaaataatagaatttgctcaactttgtggaaagtatggcagtaatgtaaacaaaggtagttatgcaaaatgttagcatgccttctgaaaaatttacaacttgctaattaataaattgggttgaattgacctatttcataatgtagatttatattctagttcatatattttagagttcttaaaaaatacctttatttgttacaaaaacataacgataataagtcacctattgtaaacgtttgtgtcagtagtatggcattgctgattgttttcagccataatgtacttagaaaaagctcacaattgctattactgacacaaaagaaacagcaagtagtatgctctggattattttaatatcaaaagtgttgttgtttcacccaaacaaaaaatggttgtcctagattgaattattgtaaatgaatactgttatcccaattaatggtaaaaactaggaaatatgaactagaatgtcatgcacaaaaaacagattgcaaatagagtaactctacccatcacttaagagctaagaagcaagcactattgaacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcctaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttca

SEQ ID NO: 343 - DNA, 2666 bp, Homo sapiens
  ENST00000261206
ggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctggggcaaagctgccgagcagatcagctggtacaagccctggaccaaaacgctggagaacaaacactcgccctctaccaggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtagaaattacttgcaaaatgaaatgtgaattgtaaaacttggcctaaacaaatctaatgaaaacatgtgaaagacctgtgccttttttttggtttgaccctgttagcattgttattagttatctataacatggcttattgaatgtcatctactgctttaggaaaaacgtatctagtgtattatttttaaaattgtacctcccaagaagaacactttaattgaaagcaacactaatatagagccacttcctgaaaccaagaatctgtagttttgatccaaaatctaaaacttaaagtcagaaaataattaaaatttttcttgtagaaattttagatattttctagtattctttagatgctcacattgttttaaataaaatagatgaaatgggaagtttaggtaatcatctagacagatgaaattattatctaggtaggagggcttttctatacatt

SEQ ID NO: 344 - DNA, 741 bp, Homo sapiens
  ENST00000548387
gatttaatggtcttggcataggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaaggtactcactctcttagagataactatctatagcagtagatttactttgcaccaagaatgtttgatcactgactggaaatgtttgcagactttactttgaagtttagagagttacttcatttgcttttatttttttttcctgtgcccagtctggagtgcagtggcgtgatctcacctgacacagttactccatatcttaaagagattttgtgtttagtgctaaatataaaaacatttattatttaacatcaaatat

SEQ ID NO: 345 - DNA, 2214 bp, Homo sapiens
  ENST00000548324
caaattattttgtgttgactattgaaggacccaaagaaataatgattcaaagataattttataaaagccaaagtaacttgtagctaatatataaaatacttttgaccaggaacttttaaagtggatgctatgaagatagagagtgtttttacacattgtttattgattttaatttcactttttctctccttagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtagaaattacttgcaaaatgaaatgtgaattgtaaaacttggcctaaacaaatctaatgaaaacatgtgaaagacctgtgccttttttttggtttgaccctgttagcattgttattagttatctataacatggcttattgaatgtcatctactgctttaggaaaaacgtatctagtgtattatttttaaaattgtacctcccaagaagaacactttaattgaaagcaacactaatatagagccacttcctgaaaccaagaatctgtagttttgatccaaaatctaaaacttaaagtcagaaaataattaaaatttttcttgtagaaattttagatattttctagtattctttagatgctcacattgttttaaataaaatagatgaaatgggaagtttaggtaatcatctagacagatgaaattattatctaggtaggagggcttttctatacattttctgagggaaagcagaacaccggggttatagctataccttcaggtcttttgttacttaggcaaggaaaaccacatgtctgacctggttcagcatgtaatccgagcactttgggaggctgaggcaggcggatcacttgaggtcagcagtttgagacgagcctggccaacatggtgaaaccctgtagctactgaaaatacaaaaataagccaggcgtggtggcgggaggctgaggcaaggagaatcacttgaatacaagaggcagaggttgcagtgagccaagttcccccactgtactccagcctgggtgacagagtaagactccatctcaaaacaac

SEQ ID NO: 346 - DNA, 864 bp, Homo sapiens
  ENST00000551745
aaaaattgtaatttgaaaggttttaggatactaaaatggagcaaacagtctctgttatgcctgggtatttggtttgctttatttgtgatagaacatggaaatattttaaaactaagatttgttgaaaaccccttattattaatattgttgtgttaaatgtataactattgaactgtcagtgaaatatgacacattttatccagtgacattttaaatgaatctcattgtaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactggtaagcattttcctagcatgtacataaatagtaaagaaatgttccaaaaagctgcaaggattggaggaaacttttgagctacgaccagcagatcagacacaaactcgggattcgagtggttcaggtttcagtaaaaataagcaatttttttattgttgtgttattaataatgtcttcataagtgacattgatgccaccattctcttggtccctaggtataaagcactaaagacctctttatcttctcttctttgtttcttatatctggtaagttactaagtctcagattttcctttgaagtgtctgttgggttcattccaccttcagtattccccttgcctttgagctctggcagctgcattatcctctgtcctgatt

SEQ ID NO: 347 - DNA, 379 bp, Homo sapiens
  ENST00000546664
gcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactggtataaagcactaaagacctctttatcttctcttctttgtttcttatatctgagactggatctccaattactgcgtcatgtgttggattaggcaattctaaaacacctccaccagggcaagcaggaaaaagcgtcccaggatacaatgttatgattttggatgacaa

SEQ ID NO: 348 - DNA, 715 bp, Homo sapiens
  ENST00000464611
cagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaa

SEQ ID NO: 349 - DNA, 1917 bp, Homo sapiens
  ENST00000331789
gagtgagcggcgcggggccaatcagcgtgcgccgttccgaaagttgccttttatggctcgagcggccgcggcggcgccctataaaacccagcggcgcgacgcgccaccaccgccgagaccgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaa

SEQ ID NO: 350 - DNA, 1845 bp, Homo sapiens
  ENST00000425660
accgccgagaccgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccaggactctcttctctgacctgagtctcctttggaactctgcagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacctt

SEQ ID NO: 351 - DNA, 2245 bp, Homo sapiens
  ENST00000462494
accgccgagaccgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccaggtgagtggcccgctacctcttctggtggccgcctccctccttcctggcctcccggagctgcgccctttctcactggttctctcttctgccgttttccgtaggactctcttctctgacctgagtctcctttggaactctgcaggttctatttgctttttcccagatgagctctttttctggtgtttgtctctctgactaggtgtctaagacagtgttgtgggtgtaggtactaacactggctcgtgtgacaaggccatgaggctggtgtaaagcggccttggagtgtgtattaagtaggtgcacagtaggtctgaacagactccccatcccaagaccccagcacacttagccgtgttctttgcactttctgcatgtcccccgtctggcctggctgtccccagtggcttccccagtgtgacatggtgtatctctgccttacagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacctt

SEQ ID NO: 352 - DNA, 1236 bp, Homo sapiens
  ENST00000493945
ctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggtgagtggagactgtctcccggctctgcctgacatgagggttacccctcggggctgtgctgtggaagctaagtcctgccctcatttccctctcaggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggact

SEQ ID NO: 353 - DNA, 1032 bp, Homo sapiens
  ENST00000484841
caccgccgagaccgcgtccgccccgcgagcacagagcctcgcctttgccgatccgccgcccgtccacacccgccgccaggactcggcgcgccggaagtggccagggcgggggcgacctcggctcacagcgcgcccggctattctcgcagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacc

SEQ ID NO: 354 - DNA, 556 bp, Homo sapiens
  ENST00000473257
accaccgccgagaccgcgtccgccccgcgagcacagagcctcgcctttgccgatccgccgcccgtccacacccgccgccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttca

SEQ ID NO: 355 - DNA, 820 bp, Homo sapiens
  ENST00000477812
cgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccaggtaggggagctggctgggtggggcagccccgggagcgggcgggaggcaagggcgctttctctgcacaggagcctcccggtttccggggtgggggctgcgcccgtgctcagggcttcttgtcctttccttcccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccg

SEQ ID NO: 356 - DNA, 568 bp, Homo sapiens
  ENST00000432588
agcttggcgcggcaggcgcgtcggttgcgccacctggcggtcgcctggaaccccacaacccaaccaaccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcc

SEQ ID NO: 357 - DNA, 657 bp, Homo sapiens
  ENST00000480301
gccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccaggtaggggagctggctgggtggggcagccccgggagcgggcgggaggcaagggcgctttctctgcacaggagcctcccggtttccggggtgggggctgcgcccgtgctcagggcttcttgtcctttccttcccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccaggtgagtggcccgctacctcttctggtggccgcctccctccttcctggcctcccggagctgcgccctttctcactggttctctcttctgccgttt

SEQ ID NO: 358 - DNA, 569 bp, Homo sapiens
  ENST00000443528
gtctggagtaagcctcgcccccaccccaactcccaggaattctgctgagtcacttcggaggccacagctgcaaccttgggaacaatacgagtcattcaattcactaggcagcgtcccagcgctcacctgggggacttggccacggtctcttgttagaagcctcttcatggacaacgtggccaaccccacctcacccctatcgtctcccccggccacaccctgggccaatcgggctcccacgtcagggtctttgcactcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgt

SEQ ID NO: 359 - DNA, 472 bp, Homo sapiens
  ENST00000417101
gcacttcctgcccgagccgctggccgcccgagggtgtggccgctgcgtgcgcgcgcgccgacccggcgctgtttgaaccgggcggaggcggggctggcgcccggttgggagggggttggggcctggcttcctgccgcgcgccgcggggacgcctccgaccagtgtttgccttttatgctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtgg

SEQ ID NO: 360 - DNA, 561 bp, Homo sapiens
  ENST00000414620
attctgctgagtcacttcggaggccacagctgcaaccttgggaacaatacgagtcattcaattcactaggcagcgtcccagcgctcacctgggggacttggccacggtctcttgttagaagcctcttcatggacaacgtggccaaccccacctcacccctatcgtctcccccggccacaccctgggccaatcgggctcccacgtcagggtctttgcatagagatggagtttcaacatgttgtccaggctggtcttgaactcgtgaccacaagtgatccacccaccatggcctcccaaagtgctgggattacagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacga

SEQ ID NO: 361 - DNA, 2794 bp, Homo sapiens
  ENST00000423391
gtctgaaagcatttctggagtgttttaggcctgttcactttctcttactcactgtctattcacttgtcctgttcactcgtctggaagatctcagccagcaccatgactgacaatgagctgtctgccttggtagtggataatgggtcagggatgtgcaaggcaggctttggtggtgacgatgccccccgggctgtgttcccctccatgatagggcgtcctcgacaccagggcgttatggtaggcatgggccagaaggactgctacgtgggagatgaggctcagagcaagagaggcgtcctgaccctgaagtatcctatcgagcatggagtggtcaccaactgggacgatatggaaaagatctggtaccacacattctacaatgagctccgtgtggcaccagatgagcatcccatcctcctcaccgaggcacccctgaaccccaagatcaaccgggaaaagatgactcagatcatgttcgaggctttcaacacaccagccatgtatgtcgccatccaggctgtgctgtccctctatgcctcaggacggaccacaggcatcgtgatggattctggggatggggtcactcacatcgtgcccatctatgaaggttatgccctgcctcatgccattctacgcctggatctggcagggagagacctgactgattacctcatgaagatcctgacagagcgaggctataacttcaccaccactgctgagcgggagattgtgcgagatgtcaaagagaagctgtgctacgtagccctggactttgagcaggagatggtcagggcagccgcatcctcctcaccggaacggagctatgaacttcctgatgggcaggtgatcaccattgggaatgaacgcttccgatgccctgaagccattttccagccttcctttctgggcattgagtccagtgggatccatgagacaaccttcaactctatcatgaagtgcgatgtggatattcgcaaggatctctatgccaacaccgtgttatctggagggagcaccatgtacccaggcattgctgacaggatgcagaaagaaatcataaccctggcacccagcaccatgaaaatcaagatcatagctcccccagagcggaagtattctgtttggattgggggctccatccttgccagcctgtccacattccagcagatgtggatcagtaagcaggaatatgatgaggctggtcctcctatcgttcacagaaaatgtttctgaatgggcttccatattagtgggcttacattttcccttttcctaggtcacagtgatggtactgcttttatccgctttcagtagaatcgaggtaaatacgtcactcttcctagtgtaaaccagcaaacccatctctccatccaagtaacctgggctcttacccagataaccacatccggttctccatcaagtgaaggtgaattctaataccatattcctttttctttgcctatactgttcaaagataggtaggccagcttaaatacatataagtgacaaggagtaaaatcacgagaaatgtcatttcagaatggataactataattatcaagctttaaaacttagttctcgctaaaatatttaacaagaacaggctgtataaacttgtttaaaaaaaaaaggtgcgtatgcatttagcagccgtgtcttactagttaagtatctttgttttgtttacttctttgtatggagataatgaattataaagttcaataatatccatatatacataagcaccagggaaataaaatatattgtgaaatatgctgatgtatctagctatctgaacagctaatgtgaatttctttactcccaaaagtcatcgttgtactaggtacatattttaattgtttcccttactaaataagcataatgagacagccaccattccattaatgtttataaatcatctaaattttcagctcatagtggagttctgctggtcaaattatattttaatatctttcttactgaaccttctcataccaaaactacagacaatgtctaattcttaagagagatagatattataatatcaaattaatgtcattatggtacaatttgacagaggtaattttatttctatttcttagtgtaatagcacatcttaaataatttctgtagaccaggattacagatacttctcttgtgcaaggatttcactgtgggaaaatatagctgcagcatctttattaattatacattttactaccagtatactaacacagttttatccttggaaagcttttagaataattctactttattatgtccagtaactagcaatacttatttatgcaaagtgtctctgagatactaacatctttgaaaatatcaatgtatgttcctataatgtctaaaatattttagttactccagtgatgatttattaaccaattttaagtaccagtatgtttattccaatctatgcagtgatttctgaatatttggatatcagcattatttgtatttttcagggtaatttctgaaaatttaaaatatttatttggattgcttattcaggcattataaggtactctggaggaaggaatcacttctctttttttcttagttgggaaacttgtacttatgttataaatctttaaaatggaatcagtaagaattttttgtttaaggtaatacttttcaaataatttgattattccttattggctttatctgacaacataatctttaaaatgcatgtaaccaaaattaatctccaaaaacactttattttatataacttgctttcagtacattaaaattgcttcatacttgtata

SEQ ID NO: 362 - DNA, 4106 bp, Homo sapiens
  ENST00000290378
attcaggctggcggggactagaccagaagggtgccctgtcctgggtgccccttttgcagccactcagatgtgctgctgcggtgtcctttgtgctggtggcagccctggaagatgagaagccgctgttgctcccctgctgccctggcccagctgtcaggacccctcagcagagggcagggcgccaagccttcccactgcatgtggcttattgtccccaaggctggcagggctgcggaggaccgaatccacagaccatccagggagcacccacaccccagaaagggggaggggtgggctggcgtcacttagtcttcccctgccccctacccttcagcgcctgcccctccccagctccctatttggccatccccctgactgccccctccccttccttacatggtctgggggctccctggctgatcctctcccctgcccttggctccatgaatggcctcggcagtcctagcgggtgcgaaggggaccaaataaggcaaggtggcagaccgggccccccacccctgcccccggctgctccaactgaccctgtccatcagcgttctataaagcggccctcctggagccagccacccagagcccgctgccgccggagccgagccgacccgccccgccgacgaaccccctgaagctgtgccaagatgtgtgacgacgaggagaccaccgccctggtgtgcgacaacggctctgggctggtgaaggccggctttgcgggcgatgacgcgccccgcgctgtcttcccgtccatcgtgggccgcccgcggcaccagggagttatggtgggtatgggtcagaaggactcctacgtaggtgatgaagcccagagcaagagaggcatcctgaccctgaagtatcccatcgagcatggtatcatcaccaactgggacgacatggagaagatctggcaccacaccttctacaatgagctccgtgtggctcccgaggagcaccccaccctgctcacagaggccccgctgaaccccaaggccaaccgggagaagatgactcagatcatgtttgagaccttcaatgtccctgccatgtacgtggccatccaggcagtgctatccctgtatgcttctggccgtaccacaggcattgttctggactctggggatggtgtaactcacaatgtccccatctatgagggctacgctttgccccatgccatcatgcgtctggatctggctggtcgggacctcactgactacctcatgaagatcctcactgagcgtggctactcctttgtcaccactgctgaacgtgaaattgtccgtgacattaaagagaagctgtgctatgtcgccctggattttgagaatgagatggccacagctgcctcttcctcctccctggagaagagctatgaactgcctgatggccaagtcatcactattggcaatgagcgcttccgctgtcctgagacactcttccagccctccttcattggtatggaatctgctggcatccatgaaacaacttacaatagcatcatgaagtgtgacattgatatccgcaaggacctgtatgccaacaatgtcttatctggaggcaccactatgtaccctggtattgctgatcgtatgcagaaggaaatcactgctctggctcctagcaccatgaagattaagattattgctccccctgagcgtaaatactctgtctggattgggggctccatcctggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtcttccaaaccaccttccctcatctttcatcaatcattgtacagtttgtttacacacgtgcaatttgtttgtgcttctaatatttattgctttataaataaaccagaccaggacttgcaacctataaaagcctctcgtttgtttttggggtaggcgtggggtggggcaggtgtttgctttgacaccctgagcattgtcaaagttcagtaccacaaggttcatccagatgaattaatatgacagttagctgggagttataatgctaacttttgatttcatattttgagacagaatcatgaatatatttcatacctgaaaagcagattaaggtttagttccatataagtaagaaatgaaattgaataagatagttctctagaattagttgctgcagatgacactgaagattattttaacatatgttccagttgtttttgtaaccttgcagaaaatacacatatattgataatgagaaagtcaaagattattttaaatgaattggcttaacttttcaattctttgaactcttcaattttcttcctgggggctatgaaagaaacatgaaggttagctgacagttgggccagccacatcccattgcaaataccctctaaacatatcaagaccattgtgtgtgtgcaaaacaaatgtgaggaagcaggagccaaacacttctgcctgatcagtgactaacttgcgagacagaagccttcaatctcttcgtttctttgaaatcttgagatcttgggttgagtgaactgaaggctgcgaggtcctgagggagcaaggggaggcgagagccacagtgtttgctttgctctgtgcagagctctctgcaaagtatggtgggaaggctgctaggggcagcgttgaaaagaattgaatgtgttccatcctcgaggagttcacacacctacacataatcccccagtgcgtgtggcctggaggctttaaggagatgtatgtgggtctgggtcttagagaatggtcaggaattagggaggtgagaagagcagagaggacatctcagcagaaggaagtgtggcagaagccaggatacaagacatggggcaggctggtaggtgctgatgaattttagaaaatccactgggaaaggtagatttcaactagattgcagaagccttacagatttttgttttcaaattaattgccagtgaactgttagcattcacagaagtgtttgaatagacttaattgaattttattgatgaggattcaagacacagagattaagcaactggtgcaatgttataaactttatttgtggaatgtgctagacaggaactcagattttctgacacctactctgatggtgtctctaaaataatctttctaactttatagtttatcaagggtaaccccattctatcacatgccttttgagaatttgggttcaatatttggagtactctggactcatcagacatctttaataaattgtaatacattgccactgtcattcaaggtcctatgtgtgtctttttgcctattcataccaaaaatatcttttgatccctgactctgggtcgggcatagtattaagggcaggggacacaaagatgtatgagagcacattttctgtgaataaaaagctcagagtttagagttctgtatgtagcatattcaaatggaaggccttctatgcaataaaggctaaataatacatcaacttggtggcattttatttagataaggtgcaaacattattgtacatatgccccccgcccccaccaccccattgtatcctatagcacagttgaactggtttaaaagccatgcatggggaggtatgatttcactagtttttgtgtctctttcttttcctctgtacaattgagtgcataaatattatgaattgtatcctctgaacacagtattaatgctttaactgtagatgattggctggggtatcacctctggttctttccatctgtgattagaaatggagaggacatttttatttctatgtaaaagtagaagctttaagaatcagcttctgatatttatatcagaagaggtaagcacccagattcttgttgaattctgaggtcttctcatctttgcttgattatagggtataaagtattagaacaattgaatcttaaaaattgtgcttaaggaaggtactaagacaaaaatgtttgcttaaggtaatcttcatatgtatacaataactgagacatggatagtgcctacgtctttggttaaagtgcaataaacaaagaactatataaatt

SEQ ID NO: 363 - DNA, 636 bp, Homo sapiens
  ENST00000557860
gcttacataatgtgctcgtggctgacaagaaagatggtcatttgaaagtgtcctcgggaattttttctactataatagttaaaaagatgagctgcagtttgcttcagatttagtattcctgatgcgcatttttattctttgtgtgcattgttctggactctggggatggtgtaactcacaatgtccccatctatgagggctacgctttgccccatgccatcatgcgtctggatctggctggtcgggacctcactgactacctcatgaagatcctcactgagcgtggctactcctttgtcaccactgctgaacgtgaaattgtccgtgacattaaagagaagctgtgctatgtcgccctggattttgagaatgagatggccacagctgcctcttcctcctccctggagaagagctatgaactgcctgatggccaagtcatcactattggcaatgagcgcttccgctgtcctgagacactcttccagccctccttcattggtatggaatctgctggcatccatgaaacaacttacaatagcatcatgaagtgtgacattgatatccgcaaggacctgtatgccaacaatgtcttatctggaggcaccactatgtaccctggtattgctgatcgtatgc

SEQ ID NO: 364 - DNA, 696 bp, Homo sapiens
  ENST00000560563
tatgagggctacgctttgccccatgccatcatgcgtctggatctggctggtcgggacctcactgactacctcatgaagatcctcactgagcgtggctactcctttgtcaccactgctgaacgtgaaattgtccgtgacattaaagagaagctgtgctatgtcgccctggattttgagaatgagatggccacagctgcctcttcctcctccctggagaagagctatgaactgcctgatggccaagtcatcactattggcaatgagcgcttccgctgtcctgagacactcttccagccctccttcattggtgagttgtagggtctggtgcagaggcacgattttccctggaaatcttagggtctcccagagtaaaatctagaaggctcaagaagcccttgagttaaaagaagtcatagtttggattcccacacagctcaacctcaagtcctgatggctcattaaaggggaagtctatgttctgctctagtgatataataaaggatgacacactgagttcatctcaaaataaaggatgacacagagtagtaactgaatagcacgtatctgcaggaaaagggctagttcacaagagctgacttattcccgtaagtttcactaccaagtagctggactttccaagttcctcatcattaaatgcaataacattcctactcatattaataactgggcacttat

SEQ ID NO: 365 - DNA, 1537 bp, Homo sapiens
  ENST00000160382
aattggccgctgagagtcccgccccgccagggatcccgggagctgtccggccgcctcggtgctgatcccgccaccgcccacgggccgctagcagcgcagcgggcactatgagcgggggcgtctacggcggagatgaggtgggggcgctggtctttgacattggctccttctcagtccgcgctgggtacgctggggaggactgtcccaaggctgacttccccaccacagtggggctgctggccgcggaggaggggggcgggctggagctggagggggacaaagagaagaaagggaagatcttccacatcgacaccaatgccctgcacgtgcctcgggatggagcggaggtcatgtcgcccctcaagaatggcatgatcgaggactgggagtgcttccgagccatcctggatcacacctacagcaaacacgtcaagtctgagccaaacctgcacccagtgctcatgtccgaggctccgtggaacacacgggccaagcgggagaagctgacagagctgatgttcgagcagtacaacattcctgccttcttcttatgcaagacggctgtgctcaccgcctttgcaaacgggcggtccactggcctcgtgctggacagtggagccacccacaccacggccattccagtacatgacggctacgttctgcagcaaggcatcgtcaagtcccctctggcaggggacttcatctccatgcagtgccgggagctgttccaggagatggccattgacatcatcccaccttacatgatcgcagccaaggagcctgtccgggagggtgcccccccaaactggaagaagaaggagaagctaccccaggtctccaagtcctggcataactacatgtgtaatgaggtgatccaggacttccaggcctccgtgctgcaggtctcagactccccctacgatgaacaggtggctgcacaaatgcccacagtgcactacgagatgcccaatggctacaatacagactacggcgccgagcgactccgcatccctgagggcctgtttgatccctcgaacgtcaagggcctgtcggggaacaccatgttgggtgtgggccacgtggtgaccaccagcatcggcatgtgtgacattgatattcgcccgggcctgtacgggagtgtcattgtcaccggcgggaacacactgctgcagggcttcactgacaggctcaatcgagagctttcccagaagaccccaccgagcatgcgactgaaactcattgccagcaacagcaccatggagcgcaagttcagcccctggatcgggggttccatcctggcctcactgggcactttccagcagatgtggatctccaagcaggaatatgaggagggcgggaagcagtgcgtggagcgaaagtgcccctgatggcactcctccccacacacctgctcccaagctcagatggaagtcccttaacccccatgccacattgcccccctcctcctttccctcttgtcctcattaatggtgatgtttctgggttgaaagaagtaaaaatgttttaagaaaaaaaa

SEQ ID NO: 366 - DNA, 947 bp, Homo sapiens
  ENST00000487125
cccaccgcatgaaaggcacacatggagagagaggcatgccccattctctctcctctccatcagggaagggtgagaaacccctcttgcaggcagcacagcagagcctgcagcgccaggtagctgcagagctgggaacagtgccaggaaggtgggggtgggggtcaggtgggctaggaaagggtgttcctacactgtgcccccacaggagcctgtccgggagggtgcccccccaaactggaagaagaaggagaagctaccccaggtctccaagtcctggcataactacatgtgtaatgaggtgatccaggacttccaggcctccgtgctgcaggtctcagactccccctacgatgaacagcagagtcctgctcccttctgggtagggtggctgcacaaatgcccacagtgcactacgagatgcccaatggctacaatacagactacggcgccgagcgactccgcatccctgagggcctgtttgatccctcgaacgtcaagggcctgtcggggaacaccatgttgggtgtgggccacgtggtgaccaccagcatcggcatgtgtgacattgatattcgcccgggcctgtacgggagtgtcattgtcaccggcgggaacacactgctgcagggcttcactgacaggctcaatcgagagctttcccagaagaccccaccgagcatgcgactgaaactcattgccagcaacagcaccatggagcgcaagttcagcccctggatcgggggttccatcctggcctcactgggcactttccagcagatgtggatctccaagcaggaatatgaggagggcgggaagcagtgcgtggagcgaaagtgcccctgatggcactcctccccacacacctgctcccaagctcagatggaagtcccttaacccccatgccacattgcccccctcctcctttccctcttgtcctcattaatggt

SEQ ID NO: 367 - DNA, 1078 bp, Homo sapiens
  ENST00000485601
ccagggatcccgggagctgtccggccgcctcggtgctgatcccgccaccgcccacgggccgctagcagcgcagcgggcactatgagcgggggcgtctacggcggagatgaggtgggggcgctggtctttgacattggctccttctcagtccgcgctgggtacgctggggaggactgtcccaaggctgacttccccaccacagtggggctgctggccgcggaggaggggggcgggctggagctggagggggacaaagagaagaaagggaagatcttccacatcgacaccaatgccctgcacgtgcctcgggatggagcggaggtcatgtcgcccctcaagaatggcatgatcgaggactgggagtgcttccgagccatcctggatcacacctacagcaaacacgtcaagtctgagccaaacctgcacccagtgctcatgtccgaggctccgtggaacacacgggccaagcgggagaagctgacagagctgatgttcgagcagtacaacattcctgccttcttcttatgcaagacggctgtgctcaccgcctttgcaaacgggcggtccactggcctcgtgctggacagtggagccacccacaccacggccattccagtacatgacggctacgttctgcagcaaggcatcgtcaagtcccctctggcaggggacttcatctccatgcagtgccgggagctgttccaggagatggccattgacatcatcccaccttacatgatcgcagccaaggtggggcctctggggacatggagctgccactagagtcctggccactcgccccatggccgtcaaccctctgacacatgagatatcagagcagagagcagcaggctccccagtgggtcctggctccagttcctccttttataatcgaggcatccgaaatccagacaggctgagggatatgctgaggtcatgaaaccagctggcagacagcaggatgtgtgagggccagtgtggtgggttctagggtccaatatagacccaggttcaagttctgcctctgccgtgcaagagctgcaggaccggtcaggcatggtggctcacacctgtaatc

SEQ ID NO: 368 - DNA, 790 bp, Homo sapiens
  ENST00000487225
gcagcgggcactatgagcgggggcgtctacggcggagatgaggtgggggcgctggtctttgacattggctccttctcagtccgcgctgggtacgctggggaggactgtcccaaggtgagccttccagtctcctctccaaatcctaggggcttcggacccttcttcaggctttccagtgacccagggctctcccagatcgcccagaagctctgctgagcgggaatatgggaataaacccaggggcggtctgaggaccctgctgtggggctggacaggggcaagagggtgacctctctccctgccaatactcccccaacccttccccaccaggctgacttccccaccacagtggggctgctggccgcggaggaggggggcgggctggagctggagggggacaaagagaagaaagggaagatcttccacatcgacaccaatgccctgcacgtgcctcgggatggagcggaggtcatgtcgcccctcaagaatggcatgatcgaggactgggagtgcttccgagccatcctggatcacacctacagcaaacacgtcaagtctgagccaaacctgcacccagtgctcatgtccgaggctccgtggaacacacgggccaagcgggagaagctgacagagctgatgttcgagcagtacaacattcctgccttcttcttatgcaagacggctgtgctcaccgcctttgcaaacgggcggtccactggcctcgtgctggacagtggagccacccacaccacggccattccagtacatgacggctacgttctgcagcaag

SEQ ID NO: 369 - DNA, 309 bp, Homo sapiens
  ENST00000489904
cggaggtcatgtcgcccctcaagaatggcatgatcgaggactgggagtgcttccgagccatcctggatcacacctacagcaaacacgtcaagtctgagccaaacctgcacccagtgctcatgtccgaggctccgtggaacacacgggccaagcgggagaagctgacagagctgatgttcgagcagtacaacattcctgccttcttcttatgcaagacggctgtgctcaccgcgtatcctctggactgagctgctctgactgggtggagggctggggtggggcctgtgctgagctcagctgtgatgagct

SEQ ID NO: 370 - DNA, 444 bp, Homo sapiens
  ENST00000461605
agggatcccgggagctgtccggccgcctcggtgctgatcccgccaccgcccacgggccgctagcagcgcagcgggcactatgagcgggggcgtctacggcggaggctgacttccccaccacagtggggctgctggccgcggaggaggggggcgggctggagctggagggggacaaagagaagaaagggaagatcttccacatcgacaccaatgccctgcacgtgcctcgggatggagcggaggtcatgtcgcccctcaagaatggcatgatcgaggactgggagtgcttccgagccatcctggatcacacctacagcaaacacgtcaagtctgagccaaacctgcacccagtgctcatgtccgaggctccgtggaacacacgggccaagcgggagaagctgacagagctgatgttcgagcagtacaacattcctgccttcttct

SEQ ID NO: 371 - DNA, 4863 bp, Homo sapiens
  ENST00000366578
gcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccattggcgctgaagaaattgttgatggcaacgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagacatcgtgaacacccctaaacccgatgaaagagccatcatgacgtacgtctcttgcttctaccacgcttttgcgggcgcggagcaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagaggggaaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattgcccctaggggagtatatttgggattctaatgttttattttcatgcttatccaaagattactattgtatcttcaaatgaatttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtaaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaaagccagaaagttgtgcttcctttgaggctattagggggctctgtggtgttttaggatgggtgtgggtaactcatctacctaaacttttaatttctttacaacattcagcaagagagggggtcagtagtctctatctgctaataaatgaagaaaggaagtaaactctgaaaaataataaacatgtttatactctcattttaggtattatttttatttctgaagctggatgctcaaaaattaaaacgtttataagtttctaaattaaacttaatttataaaagaaaaaa

SEQ ID NO: 372 - DNA, 1632 bp, Homo sapiens
  ENST00000492634
gcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccattggcgctgaagaaattgttgatggcaacgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagatttagtatacactgccagacccgatgaaagagccataatgacttatgtttcctgttactatcatgcttttgctggtgcacagaagacatcgtgaacacccctaaacccgatgaaagagccatcatgacgtacgtctcttgcttctaccacgcttttgcgggcgcggagcaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcagg

SEQ ID NO: 373 - DNA, 453 bp, Homo sapiens
  ENST00000494762
gcacgccaccctcctcgtcccctctcatcacccacctcgttccatgctgtgtgtgcgcattcccgtcgacagagccgtcctgtttacctattgtgttttacaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggct

SEQ ID NO: 374 - DNA, 341 bp, Homo sapiens
  ENST00000492101
tgatcggtgccagaaaatttgtgaccagtgggaccgactgggaacgcttactcagaagaggagagaagccctagaggttgcctagtgaaaggaacctctaaagaaaacatgaaaagtggaagaaagagggaaatgggaagttgggagctttgtgctgtaatttatccagacagcagcgaagtatatttttcaattttaaaaaatccaggggtgatgagattacggcataaatctactttgtatctggtagtaacagtacgtttccaaaagtccttctacctgagtaaattgagctgtgagtgagtcgggaaatcagagatgtgcaaagggaagatggaacc

SEQ ID NO: 375 - DNA, 841 bp, Homo sapiens
  ENST00000461367
tgagaccacagctggcctctaacccttgttgtccttgggccctgacaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtg

SEQ ID NO: 376 - DNA, 5103 bp, Homo sapiens
  ENST00000546208
gacgggcggcgcggctattaagccgcgcggcagctgctcgcagccggagctggtgcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccattggcgctgaagaaattgttgatggcaacgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagatttagtatacactgccagacccgatgaaagagccataatgacttatgtttcctgttactatcatgcttttgctggtgcacagaagacatcgtgaacacccctaaacccgatgaaagagccatcatgacgtacgtctcttgcttctaccacgcttttgcgggcgcggagcaggttagacaaagtcttaaagcacactcagctctgtggaaggatccccctccagaaagttctacatgttcatatcaggagatgaggaggtcttcagtgaattcaagtgcaatggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagaggggaaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattgcccctaggggagtatatttgggattctaatgttttattttcatgcttatccaaagattactattgtatcttcaaatgaatttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtaaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaaagccagaaagttgtgcttcctttgaggctattagggggctctgtggtgttttaggatgggtgtgggtaactcatctacctaaacttttaatttctttacaacattcagcaagagagggggtcagtagtctctatctgctaataaatgaagaaaggaagtaaactctgaaaaataataaacatgtttatactctcattttaggtattatttttatttctgaagctggatgctcaaaaattaaaacgtttataagtttctaaattaaacttaatttat

SEQ ID NO: 377 - DNA, 4906 bp, Homo sapiens
  ENST00000542672
gacgggcggcgcggctattaagccgcgcggcagctgctcgcagccggagctggtgcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccattggcgctgaagaaattgttgatggcaacgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagatttagtatacactgccagacccgatgaaagagccataatgacttatgtttcctgttactatcatgcttttgctggtgcacagaaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagaggggaaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattgcccctaggggagtatatttgggattctaatgttttattttcatgcttatccaaagattactattgtatcttcaaatgaatttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtaaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaaagccagaaagttgtgcttcctttgaggctattagggggctctgtggtgttttaggatgggtgtgggtaactcatctacctaaacttttaatttctttacaacattcagcaagagagggggtcagtagtctctatctgctaataaatgaagaaaggaagtaaactctgaaaaataataaacatgtttatactctcattttaggtattatttttatttctgaagctggatgctcaaaaattaaaacgtttataagtttctaaattaaacttaatttat

SEQ ID NO: 378 - DNA, 1566 bp, Homo sapiens
  ENST00000377776
agcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctc

SEQ ID NO: 379 - DNA, 2216 bp, Homo sapiens
  ENST00000256001
agcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatacaaatcgatgtttatatttcctatcattttgtattttatggtatttggtacaactggctgatactaagcacgaatagatattgatgttatggagtgctgtaatccaaagtttttaattgtgaggcatgttctgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgtaaatatc

SEQ ID NO: 380 - DNA, 1692 bp, Homo sapiens
  ENST00000397282
gggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctattt

SEQ ID NO: 381 - DNA, 319 bp, Homo sapiens
  ENST00000488782
gaagccatcgataaacctacatatgctacaaagtggccgatacgacatggaatcattgaagactgggatcttatggaaaggttcatggagcaagtggtttttaaatatcttcgagctgaacctgaggaccattattttttaatggggtaactatctccttcctgctgtaatcagtgaccagacagaacctccactcaatacaccagaaaacagagagtatcttgcagaaattatgtttgaatcatttaacgtaccaggactctacattgcagttcaggcagtgctggccttggcggcatcttggacatctcgacaagtg

SEQ ID NO: 382 - DNA, 5543 bp, Homo sapiens
  ENST00000479402
aaatacaaaacttaactgagcgtgatggcatgtgcctgtaatcccagctactctggaggcagaggcaggagaattgcttgaattctgggaggtggagtctcccagagatccgagattgggctactgcacttgagcctggttgacagagtgagacgctgtctcaaaaaaaaaaaaaaaaaagttttcattacaaattgttgaagcagaaggatatttaaaaatgtatacggaatggagacacctctttttcacttaacaattcatcatagagattgtttcttcatagagttcatttttttaaattgttccaaagtgtttagtgatgggtatttaggttgtttctgatcttctgatacagacaatgttgactttttacctttccaagctactttgttttagttgggtctcttaacctcagaatgtaatttgattttgtttttgtttttaactgagagacttttagtagttgaatttcccatttgtatttgctgataattttagtaatagcaactcacttccattgaacacatctgtgtatccagtactgctctaagcacattatttagactgcctttaatctttccaactctctgagtggggtactaattacctgcactttacccatgaggagactcagggagagaggaaatagcttaccaagcctagtaaagtggaaggctgggatttgatcccagtcagtttgacttcacatctcttaatcggactggtatggcatgctactgtgtgacagatacgtttggtcttaatttaactattttttaaaaatgttatgcttcatgtttttaatgtattttatttatgtattagtattttttaactgaagacttgtttttctctttgctttttattgggtgtgtgttcttggtaataattaaaaggactcatgtttgcatattttagtataatttgatatatttaccctgtatttgtttaggggtaactatctccttcctgctgtaatcagtgaccaggttggtattgccacatgttcttgcctccccttccttctctccaccacctgcttttgattaatgatgtcactaaacttattccagtgttaacatttataactttatgtttactaatgcctctgatactttatcagttttaaataatatcttttgatttcactgtaagaggcaagtgtctttacactctctccttctttccttgtgcactgctcaacttgataacatttttttccattaaaatttataacatttacattctgttcttaattcccagaaaataaaagtctttttttttttttttttttttttttttttgagacggagtcttactccatcgcccaggctggaatgcagtggtgcgatctcagctcactgcaacctccgcctcccacgttcaagcaattctcctgcctcagccacccaagtagctgggactacaggtgcacaccaccatgcctggctaatttttgtatttttagtagagatggggtttcaccatgttggtcaggctggtctcaaactcctgacctcaggtgatccgcccgcctcggcctcccaaagtgctgggattacaggcatgagccaccgtgcccggccaaagaaaagtctttattcctacatcttaaatggcttcattgctcactgtaagtcttttgctggactttctgcattcttcttgagtggataaagtttatcctctaatagttcatgaacccatacattttggctcatgggaatgaaattttccaagttcttgtatgtttaaggatatatattttttctccttagtattttattttattgtttttttttaaattgacacataatgtgcatatttatggggtacagagtgaagttttgatacatataatgtgtggttatcagatcagggtaattagcatatccatcatctcaaatattagatattttgattttgtaacatacttgattgacactgtggccagatatagaattcttgggtcgtaccttcttcccttgaagactctaagtgtggccctatgtgtcctagtgttaaatgtagccgtgttgaaggctgaggctgattgtactttccctgtcgtaggggtgtattagtctactcggctgctgtaattttgtttataccacaggttgggtggcgtaaacagcagacagttcgttgttttctcacagttctggaggttagaagtccaaggtcgaggtgccgtcggggttggctcctggcgcagccctcttcctggcttgtatgtggtcacctttcctgctgggtcctcacatgcctttcccctgtgtgagcgtagagtggggagagaataggagagagagactgatttctggtgtctcttccttttcttagaagaccttcctccagtcctgtcaaattagggccccacccctatgacctcaggtaaccgtgatgacctcttgaaaggccctatttccaattatagtacactgggagttagggctttaatgtatgaactggaggtagggggagcacagttcattcataataaagggtaatgtatacgttttgcccaaaggtccagagactttttattttttcagttttaaatacgagatatagacccatatttgttgacaaggaaaaatgttcatagtatattgttgaatgagaaaaatcaagtttatttattctttttctgtttctgttgtctgtcattttgtcctgtttgatgacggttattgttttaaaatagatacttggattcttggaaatgtctttggaaattcttggcaatttttatctgctttgtttcaatatttttccagatattttttttttcggtcttttggagacaggatcttgctctgtcacccaggttggagtgcagtggcacaatcttggttcatgtagccttcacctccgaggctcaagtggtcctacctcagcccccgagtagctgggatcacaggcatgtgccaccacacttggctgacttttaaattttttcatagaggtggggtctcccaatattgcccaggctggtctcaaactcctggactcaagtgatcctccctcctcagcctcctaaagtgctaggatgatgggcgtgagctaccacgcctgcccctggatatgtgtttttgtctgccatttgtttttcctcttttctctgtcccttttctttctctttgagtgtttttatatcactgttggctggcttctttgtgccccttactcgtctctgaatgagcagagttcttctggactaatggcgtgtgggtaggctggggaggtcctgggcagcgtctgggggaagctgtgatctgccctggactcttcccttgccgctggactgtaagggtgcttggcctaaccctgcctgctctgccaccctgtggctcctcacaccggcctgtcctgagcaagggcttgctgctgctcctctggctctcctttgctgagacctgaagtcaccggttcgcctttgatgtcctcactcgtcttggttgtgttttcatagcccttggcaacttgcttctgggatattcagtttcggggtgtttaggtgttacgttattgaagataagagtttctttttctgtaacttgttctaatttgggtgggtaataagaacagaggccttcagagaagtatttactctgacgtcttaaagcttttaaggcccatggccagatttctttaatacactttgggcatcctctgtctgtaaaattagggaattgtataatgtcctcgctaacatactttcaggttaacctgtttatggttctgatgtatttacatgaaattcgggtaaacactaaatatagtgaatgttttcttacagacagaacctccactcaatacaccagaaaacagagagtatcttgcagaaattatgtttgaatcatttaacgtaccaggactctacattgcagttcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatacaaatcgatgtttatatttcctatcattttgtattttatggtatttggtacaactggctgatactaagcacgaatagatattgatgttatggagtgctgtaatccaaagtttttaattgtgaggcatgttctgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgt

SEQ ID NO: 383 - DNA, 4571 bp, Homo sapiens
  ENST00000200557
cgctgagccccggcgccgtccctgccgcccccacctctccgcgacccccgcccggccccgcgcccccgccccggctccgcagctggcgcctccccacccccgtccctgctcccgccctccccgcgccgctggcagccgcagcccccggaccgggaggaatgagcgagccatgaggctgctgcggcgctgggcgttcgcggctctgctgctgtcgctgctccccacgcccggtcttgggacccaaggtcctgctggagctctgcgatgggggggcttaccccagctgggaggcccaggagcccctgaggtcacggaacccagccgtctggttagggagagctccgggggagaggtccgaaagcagcagctggacacaagggtccgccaggagccaccagggggcccgcctgtccatctggcccaggtgagtttcgtcatcccagccttcaactcaaacttcaccctggacctggagctgaaccaccacctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggcaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccacggcgggggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctcgcgctgtagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatctggctgggtccagtgcagtaagcaggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccattgctggggctgtcctggttgcagccatcgtcctgggcggcacgggctggggatttaaaaacattcgccgaggaaggtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcgcctggagggatgcccccaggcagccaccagtggacctagcctggatggcccctccttgcaaccaggcagctgagaccagggtcttacctctctgggacctagggggacggggctgacatctacattttttaaaactgaatcttaatcgatgaatgtaaactcgggggtgctggggccagggcagatgtggggatgttttgacatttacaggagggcccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcggggggggttctagaaaatatagttcctataataaaatggcaccttccccctttcaagaagggtgattctggggccgactcagggtttaggtgccccctggtgtggcctagatgtccccacctgggccatctttctggggaggactctcccaggtagggaaggccagaggtggcccagtgcctggagggttagggtctctgcctgggatatgcaagaggaagtaggaaagggaggtctcatggatgatcctaggctgctagaagtccttaaggccccatctagtccattccactccctacccccattccagagccgagtagtaagtttacagatgtttcccccattacgtacccccacccatccctgctgcagcgagcctgagagccaggtagagccaggcacagctcctcagtcttctcacacagtcctgccggtggccttccctcatgacccttgcttgggagggtggagcactggctccttgaccctaaaaggtagctggcaggggcaagatgggggccagctacctaatggatgaaagccacaagtgaatacagttcttgtcaccagggttgccctgccctcactcggcagggagttctgacaccccagggcccgtgagctacctgcttgagcccctgtttctggggcaccttcgaggaggcgttgtggagggcatcgccccctgtttattcacaacaccctcaggggcaaacaggcctgggacccgctgacaccattttgggtagctggatgcacccgacagcagtggggtccacacactgagctccagctggcactgcccactcaagggctgagtggaggggcccctccggccagctctgctccaccagccctgcaagctgatgcagggcgggggaagggctgggtgttgcactattgctgcgctgccttaaggcatctgtcctctggtggtgcacccgtgcacacaggtacagtgcatctgggcacagcttttggatccacacctctgcacaagtgtgaatacctctgcacatatgggcgtatctgtgtgtgctcgtgtatatggggtggggaacatgagacttcctgtgaccagtccaccctggctcccagctgtctgtatcctcctgccccgccctggcgagtgcctaccctggcagaacccagggaggagtggaggctgcctctgcctgggcctccacacagcatcctgtacatacgccacctgggctgggggtggggaggcagggccaggagcatcgattaaagatcacatcctggggcttccagggagctcacaccaa

SEQ ID NO: 384 - DNA, 4220 bp, Homo sapiens
  ENST00000355638
accgggaggaatgagcgagccatgaggctgctgcggcgctgggcgttcgcggctctgctgctgtcgctgctccccacgcccggtcttgggacccaaggtcctgctggagctctgcgatgggggggcttaccccagctgggaggcccaggagcccctgaggtcacggaacccagccgtctggttagggagagctccgggggagaggtccgaaagcagcagctggacacaagggtccgccaggagccaccagggggcccgcctgtccatctggcccaggtgagtttcgtcatcccagccttcaactcaaacttcaccctggacctggagctgaaccaccacctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccacggcgggggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctcgcgctgtagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatctggctgggtccagtgcagtaagcaggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccattgctggggctgtcctggttgcagccatcgtcctgggcggcacgggctggggatttaaaaacattcgccgaggaaggtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcgcctggagggatgcccccaggcagccaccagtggacctagcctggatggcccctccttgcaaccaggcagctgagaccagggtcttacctctctgggacctagggggacggggctgacatctacattttttaaaactgaatcttaatcgatgaatgtaaactcgggggtgctggggccagggcagatgtggggatgttttgacatttacaggagggcccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcggggggggttctagaaaatatagttcctataataaaatggcaccttccccctttcaagaagggtgattctggggccgactcagggtttaggtgccccctggtgtggcctagatgtccccacctgggccatctttctggggaggactctcccaggtagggaaggccagaggtggcccagtgcctggagggttagggtctctgcctgggatatgcaagaggaagtaggaaagggaggtctcatggatgatcctaggctgctagaagtccttaaggccccatctagtccattccactccctacccccattccagagccgagtagtaagtttacagatgtttcccccattacgtacccccacccatccctgctgcagcgagcctgagagccaggtagagccaggcacagctcctcagtcttctcacacagtcctgccggtggccttccctcatgacccttgcttgggagggtggagcactggctccttgaccctaaaaggtagctggcaggggcaagatgggggccagctacctaatggatgaaagccacaagtgaatacagttcttgtcaccagggttgccctgccctcactcggcagggagttctgacaccccagggcccgtgagctacctgcttgagcccctgtttctggggcaccttcgaggaggcgttgtggagggcatcgccccctgtttattcacaacaccctcaggggcaaacaggcctgggacccgctgacaccattttgggtagctggatgcacccgacagcagtggggtccacacactgagctccagctggcactgcccactcaagggctgagtggaggggcccctccggccagctctgctccaccagccctgcaagctgatgcagggcgggggaagggctgggtgttgcactattgctgcgctgccttaaggcatctgtcctctggtggtgcacccgtgcacacaggtacagtgcatctgggcacagcttttggatccacacctctgcacaagtgtgaatacctctgcacatatgggcgtatctgtgtgtgctcgtgtatatggggtggggaacatgagacttcctgtgaccagtccaccctg

SEQ ID NO: 385 - DNA, 2529 bp, Homo sapiens
  ENST00000535346
gctgctgcagccaccttttcctgcagtgctcggggtgacagccggtccggagcgcgggagggtaggggagcgggagaggagggaaggtgcgtccacccacctgtccccagctggccgggcccaccgcgtccctgcccctgccgccgaccggccagctctgcaggtcttgggacccaaggtcctgctggagctctgcgatgggggggcttaccccagctgggaggcccaggagcccctgaggtcacggaacccagccgtctggttagggagagctccgggggagaggtccgaaagcagcagctggacacaagggtccgccaggagccaccagggggcccgcctgtccatctggcccaggtgagtttcgtcatcccagccttcaactcaaacttcaccctggacctggagctgaaccaccacctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccacggcgggggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctcgcgctgtagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatctggctgggtccagtgcagtaagcaggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccattgctggggctgtcctggttgcagccatcgtcctgggcggcacgggctggggatttaaaaacattcgccgaggaaggtccggaggggcctaagtgccaccctcctccctccaagcctggcacccaccgtctcggccctgaaccacgaggctgcccccatccagccacggagggaggcaccatgcaaatgtcttccaggtccaaacccttcaac

SEQ ID NO: 386 - DNA, 2858 bp, Homo sapiens
  ENST00000587773
ctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggcaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccacggcgggggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctcgcgctgtagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatctggctgggtccagtgcagtaagcagccccaacagggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccattgctggggctgtcctggttgcagccatcgtcctgggcggcacgggctggggatttaaaaacattcgccgaggaaggtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcgcctggagggatgcccccaggcagccaccagtggacctagcctggatggcccctccttgcaaccaggcagctgagaccagggtcttacctctctgggacctagggggacggggctgacatctacattttttaaaactgaatcttaatcgatgaatgtaaactcgggggtgctggggccagggcagatgtggggatgttttgacatttacaggagggcccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcggggggggttctagaaaatatagttcctataataaaatggcaccttcccccttt

SEQ ID NO: 387 - DNA, 643 bp, Homo sapiens
  ENST00000588363
ccttcccctcctcccgcgtccctcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatctggctgggtccagtgcagtaagcaggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttc

SEQ ID NO: 388 - DNA, 7938 bp, Homo sapiens
  ENST00000368679
cactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttgggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacggtaattctgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaatctcagttgattttctggattccccatctcaggccagagccaaggggcttcaggtccaggctgtgtttggctttcagggaggccctgtgccccttgacaactggcaggcaggctcccagggacacctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacatttcacagcgtggatttttccagcttacacatgtgggatgacatcacagaaaccacaaaagcagcaaattaaactgtaggagagtcaatactcctgacgagtctcggggggggggcatttttatgccttcttaactttatgagaattctcaggctgaactataggccattgttcccaggcaaatcaatacatcaatgcatcctcaaaaaaaaaaaaaaaaaaaaaaaaccggctaaaactgtgtcaaaatgttcttaaggagcctatggtctccacggtgctaaaaagagcctggtgctgggccgactggcagggctgagcatcctcctgccccctcgccactgatgtttactaagcactctgagccaatgagacccccagcagcagaaagggcacaaggtggcgccagggcagcagggccagatctttctcatgcacctcgacctcttgcagactttcttcgtgagatgtactactcatttcaaaactgctttgcagggctcccctatgtattcggggggcccacggcacactcaggctggagatccttcctcactgcgctcaagatggcctcagccagacaccagttacccagctgaaagtcacaatccctcccagaagtctcccaacactagtgctgaccagaggtggggctctcaggctaggagtttcacacacaatgacaggctgctgggggacattgcaggaccccttttcctctcctctccatgctagaagccagccctaggcagctgcagttactccctgtgactcagcagcaggctgattcaacacagctgcccacacaaagccagtggctaatacatctgtttacctttccctatcacccagacacaagcccctttcccaggtcaaaccacaggccgatgcatctccagtttgacagtcaaatcactacttccattgctactttagatcagccaaagtggtgactgctgcagtgtgtggctatccctacaaggcccacccaagggatgcccaaagcccaaccttctccagggctgcagcccagagcaaccccaccagcctaagtccagcagaggacctcccacccaatgtcttgttctaattagaaggggaagttagccacagaaaatcaacttatctataattacaaaattctcttgactcaccttaaagttcctattgacatctactgcttttaaacctatttgaaaactctgatactaaaacaaatgacactctaagaaagtttgggagccccatgctgagaaccatttctgtgcagtgaggatgtttccagaagctacttacctacatgtgaatgtgccattttctttccttttgtagagaaaatcccctttactttttggaacagtaatggcagcttctagtacagccattacagtttcatatgagaaaaattaagaataactataaaattgttaaaatatccaataatggataatgatggccagaagatttaacatacaaagtaattctcaatgtaaagctattcagctcttccaggttgaatgccctgtaacccaccctgaccttccacatcatcttcaaaaagcagtttctctgttccccatgattctcctataaggtaactctttagtcctccatttagcacattttaaatcctccaaagaataagtatcatgtgattattttagctttacaaaaaaaaagttgaatggcgttttattttcatggcctataagcaggtaccttagtagggcagatataggaaaaacaaattagagcaaaacaaatcctctacaaatccaaggcaggaaaagtggtggcagagtgactcattctcctgtccctcccatcaggtcaaatcaggaggctgcagtgaatgcctgttctttgaatgtgtagcagttgttcctgtaactctttaaaacttggctataggctgtttagcacagtacagattaaagatacagttacgtaaacagcaaagtaattttatagtgcttcatccatttatcatgctttggtttgctaattttttcacatacctttttctatcacagtctgttgcttttgtacacatttctcatattggggttcgacaggtaaacacaaactgctatttcagtagaaaaagttattgttatgaatattaaacccaataaattgtataaaggtaaatatcaatgtg

SEQ ID NO: 389 - DNA, 3313 bp, Homo sapiens
  ENST00000368676
cactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttgggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacggtaattctgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcctccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcaatgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaa

SEQ ID NO: 390 - DNA, 600 bp, Homo sapiens
  ENST00000467145
gctaaattcacagatggacttaatgagggcttaggaagagcatctccaagggctgctctgaaagagggagtttagggtggaggagaaatcgtgttgagactggcgcatccggtatattcctgtgttcatcacacaaacaactggcaaacagaatgttcatcatatccccatcttcaagtctctgaggttttccataccaggaggaatgagcttggtctgacagtttctgcaagaacgctggaagtatgaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactg

SEQ ID NO: 391 - DNA, 597 bp, Homo sapiens
  ENST00000482291
cagggactcgtagacccagttggttcataaaaagcagaagctttgctttcctaacagacggaaacaggcaggtgtgcagttcaggagctgggccctcttggtctttcttgctttttgcagccatttaaggtgtgatgtttgcattcagtgagtgcatactccataagaccctgtcaaacaaatgccattcccctttccaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtacgtggccgccacaagctcggcatcaggagaggcactggcagacctgggctgtgggactgggggcatgtgctctgttttggttagcccccactcctggcgggcgctgtc

SEQ ID NO: 392 - DNA, 381 bp, Homo sapiens
  ENST00000485388
cagacaaccgagagtttcagaggcaaggaaaagatctggaaaaagttaagcagcgattaatagagattgctaatcacgttgacaagttttacagaccactgaacattcggatcgtgttggtaggcttggggatgtcagttaaattcagtctcagctccaaaggtgattcagagatgaatcagtaactgctttaatgatattaacatctcagaatcaaaaagaaccaagtattgtagatggcttaaaggagaaaagtatatcccttcatataccttgtttattctttatcaaaacattccagaatcctaactctgaaaacattaaccaattgctgtcactgacaaatgggacctgaggcctgtaaatacaaggatagagtcc

SEQ ID NO: 393 - DNA, 1145 bp, Homo sapiens
  ENST00000448723
cactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttgggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcacca

SEQ ID NO: 394 - DNA, 372 bp, Homo sapiens
  ENST00000494661
aggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggtaagtggccatgaccatggcggctctagtcttcagccatctactgcaggcaacctctgtcttttcctgctcgtgctaaagcactgagagtgagtgatgggggctcccagctcagctacacctccacctaggcaagagaacacggaggccctctctccactgcttacaagagcatggccacccaggatcttagcctcatgttcatgccccctctta

SEQ ID NO: 395 - DNA, 2839 bp, Homo sapiens
  ENST00000517951
agacgcgcctccaccgccgggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataaggtgagaccagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccagaagtgccttttgcctcctgccatgattctgagggctccccagccaagtggaactgttgtttgcttagtaattagttttaatatggccttctacaggtcaatgaggattagaatagaaccaggaatcaagaccaagttgctggttttactagtttggaagcagttttaatgaagatggaaatgtttatcaactcaacacag

SEQ ID NO: 396 - DNA, 1847 bp, Homo sapiens
  ENST00000517374
gtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 397 - DNA, 6481 bp, Homo sapiens
  ENST00000257527
agacgcgcctccaccgccgggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccatttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcacgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagcctttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 398 - DNA, 3312 bp, Homo sapiens
  ENST00000517905
tggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaaggtgagtccacgggaagccctcaaggtgaaagctggtaccagagggctccaggggggcaggtgtagagttgagaaaacaaagcaattcatgcttcttgtggtctggactgaacttccagaacaaaagccaagggcaaaacattcatgtttcttggtgcccgcttgactgtggagttttggcttcatgtgaaaggtgattcttagaatcctgagctgtggtggcttcagtcctgcccctgcacctgacctggggagggaccctgagcaagtccctcttgagtctgtttcctcatttgtacagaggctatgatgagcagtagtaccagccccatcaggttgttgtgaagagcaaggaagtgcattagtagaagccacctggcctgcgggaggctgtgtacacttggcccctcctcgtacttcttctgtgtggctgacagtctcagtttgccagtcttggcagtcaggtcagaaagggatgaggtgaagaagctggctgaccatgctgtattcccacgaggcattgagaaaactatggactgtgctgctgccttagcagggaagggaa

SEQ ID NO: 399 - DNA, 690 bp, Homo sapiens
  ENST00000519752
gggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaaggtaagactcaaaagacctcatttacactggcaggagttgacaactgaggtttgggctacctactcaactttcttagaatcccagtcatcaccattagttctgtttctggcccactctgtcctctgggtgcccattttggagatcacagatgggactttccttccttgtatgacaaacttctagaacacttcccaatgctattagttgaggaaatgaaaattcacattaatgctgacacaagctaagtgcagatgtgttggtgtcacagaaatcacttagtcttgattggaattcattaaatattgtcattgttatttttgctctgcataatacatacttcattttcttgaaggaataatgtacttggagagaaaaaagataataatataaactataaactattttaataagacgcagcgtagagacctagtactggggaatgtatctta

SEQ ID NO: 400 - DNA, 2458 bp, Homo sapiens
  ENST00000595838
atctctggctggggcctggagtggggaacggtgcatggggccgacgagtgtcctccgggctggactcactccttcctgtctccccccacccagtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagagtgcaaggatgtgaacaaggtcgcctactgccccctggtgctcaaatttcagttctgcagccgagcctacttccgccagatgtgctgcaaaacctgccatggccactagggggcgcgcggcacccggagccacagctggcggggtctccgccgccagccctgcagcgggccggccagagggggccccgggggggcgggaactgggagggaagggtgagacggagccggaagttatttattgggaacccctgcagggccctggctggggggatggagaggggctggctatccccccagagcccctcttcagcatccgccccttccagttcacatagtgagaccccccctccagggtgggtctggggaggggacagctgttcaccccagcaccctttgaacccacccttagggagtccccaacactccccccctcctttgatcggaatatgtactgtgaagagtaggggtggggaggtggtctgccggtgccctgccccccagcactgccctacccctccactccgagctgggggggaatctgtgtctgctatgggaggggggggggtagcaccacctccctgacaccctcccctgacctgactagggggaggatccaccccaacctctgccctgcccgccccaggggcaccccgacatccaggccaccccctcatggtgctacagaccctgccctggggcccacacactcctgccaggaagccctacatcaataaagttctgtcttgtgtagatttctacg

SEQ ID NO: 401 - DNA, 3333 bp, Homo sapiens
  ENST00000593913
aggggaggcggcactgtgggggctgccggcagccggggctggggagagacatgtggacacgtggcctctatggctcccgcctgccagatcctccgctgggccctcgccctggggctgggcctcatgttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgtcaggttgccaaacttttccaggactcgagtctgggaagcaccgttaacatcctcgtaactcgcctcatcctgctcacggaggaccagcccactctggagatcacccaccatgccgggaagtccctggacagcttctattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagagtgcaaggatgtgaacaaggtcgcctactgccccctggtgctcaaatttcagttctgcagccgagcctacttccgccagatgtgctgcaaaacctgccatggccactagggggcgcgcggcacccggagccacagctggcggggtctccgccgccagccctgcagcgggccggccagagggggccccgggggggcgggaactgggagggaagggtgagacggagccggaagttatttattgggaacccctgcagggccctggctggggggatggagaggggctggctatccccccagagcccctcttcagcatc

SEQ ID NO: 402 - DNA, 3749 bp, Homo sapiens
  ENST00000597188
cgcgcggggcggcgagacagcggcggcgacggcgcggaggccccgggcgcggcgcaggctccaaagaagaagaaaccaaggcccagagagggaggcccaggtgcagggagcaggcgagggaaggatccgtacaggggcccaacactactccaccaaccgaagcccccaaaaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgttgccaaacttttccaggactcgagtctgggaagcaccgttaacatcctcgtaactcgcctcatcctgctcacggaggaccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctggccacagcgttcaccattgcccacgagatcgggcacacattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagagtgcaaggatgtgaacaaggtcgcctactgccccctggtgctcaaatttcagttctgcagccgagcctacttccgccagatgtgctgcaaaacctgccatggccactagggggcgcgcggcacccggagccacagctggcggggtctccgccgccagccctgcagcgggccggccagagggggccccgggggggcgggaactgggagggaagggtgagacggagccggaagttatttattgggaacccctgcagggccctggctggggggatgga

SEQ ID NO: 403 - DNA, 3423 bp, Homo sapiens
  ENST00000596851
gcggcggcgacggcgcggaggccccgggcgcggcgcaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgtcaggttgccaaacttttccaggactcgagtctgggaagcaccgttaacatcctcgtaactcgcctcatcctgctcacggaggaccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctggccacagcgttcaccattgcccacgagatcgggcacacattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgaggtcagccgcccccttccttcgcgcccactgggatgcccaggtggggtgtccacggagacgcctctgcgcggtctccaggttagctgtcccctcctcacttcgcactggggcagcaccctgagcacgaaacgccccttccaactgcagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccct

SEQ ID NO: 404 - DNA, 545 bp, Homo sapiens
  ENST00000596911
tcctcttgggtctggggtctgtccctcttggcctcactcccccagggagcaagcaaagagttccggggtggcctggcccgtggtgtgacggggccgtgccccccagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgaca

SEQ ID NO: 405 - DNA, 831 bp, Homo sapiens
  ENST00000593826
cccatcccggagaggctgatatctctggctggggcctggagtggggaacggtgcatggggccgacgagtgtcctccgggctggactcactccttcctgtctccccccacccagtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtc

SEQ ID NO: 406 - DNA, 472 bp, Homo sapiens
  ENST00000596236
ggggaacggtgcatggggccgacgagtgtcctccgggctggactcactccttcctgtctccccccacccagtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggaggtgagtgtgggactccaaaggctgtggggccgtgaagggcagccgtgggagtgtccagcagcaggtggatgaatgcagcatcccgggg

SEQ ID NO: 407 - DNA, 1015 bp, Homo sapiens
  ENST00000603221
ctcggcattgtcccctcccaaactcccacccctccacatagcttaaaagtgttgggggcttctccagtttagatgggggaacaaagagaaccaacagctggaaaaaactagagatgaggccgttggcctagtcatcatccaggccgatttctcagaaccaccactttctcttcggctactttgcccatcccataaaagaaccccaaatccttcctgttcattcctcagcagttcccacgtttccttccagaaactcagaaggcaccaggaactgaattgcaaagttcgttagagcacagactctgaattaaagagctgggttaaactccaggctattcccttagtagctgtgtgaccttacctgtctgaagcttggttttctcccagtaagatggggtagtactgcctaaagaggtatatggcatgtataaagtgctccataaatggagcttattgggagagtataagtcacaggccatgccccgcaaggggatgcacgaagacccaccgcgagccaggaagggagcaccgggctctctgctctgggaccggcagtgagccggacatctgggtcctcccaagccgggcgggctgccccagggaggaagggaggggggcgagcctgagcgggcacctcggcccgcaggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaattt

SEQ ID NO: 408 - DNA, 1079 bp, Homo sapiens
  ENST00000601163
gtcaggttgccaaacttttccaggactcgagtctgggaagcaccgttaacatcctcgtaactcgcctcatcctgctcacggaggaccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctggccacagcgttcaccattgcccacgagatcgggcacacgtgaggccagggcacacaagagggggaggaggggaggagctgggcgggtccctcagcgcccggcagagccgacacccctttccccagattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggat

SEQ ID NO: 409 - DNA, 576 bp, Homo sapiens
  ENST00000601872
ggacattggcctggccacagcgttcaccattgcccacgagatcgggcacacgtgaggccagggcacacaagagggggaggaggggaggagctgggcgggtccctcagcgcccggcagagccgacacccctttccccagattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggtagagagagtcttcctgctttccttcctgggaggggagggggccgctggggctgggggagggaactccaccagggcacccacctgggaagtgagggggtgggagaaccgggaaggggggtgaggtgagcccccatggtgacctgggag

SEQ ID NO: 410 - DNA, 980 bp, Homo sapiens
  ENST00000596709
cgcgcggggcggcgagacagcggcggcgacggcgcggaggccccgggcgcggcgcaggctccaaagaagaagaaaccaaggcccagagagggaggcccaggtgcagggagcaggcgagggaaggatccgtacaggggcccaacactactccaccaaccgaagcccccaaaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgtcaggttgccaaacttttccaggactcgagtctgggaagcaccgttaacatcctcgtaactcgcctcatcctgctcacggaggac

SEQ ID NO: 411 - DNA, 836 bp, Homo sapiens
  ENST00000596466
cggcggcgacggcgcggaggccccgggcgcggcgcagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgtcaggttgccaaacttttccaggactcgagtctgggaagcaccgttaacatcctcgtaactcgcctcatcctgctc

SEQ ID NO: 412 - DNA, 630 bp, Homo sapiens
  ENST00000593534
cgccgccgcgctcgctcgctccctcccttcctgcgcgcgcggggcggcgagacagcggcggcgacggcgcggaggccccgggcgcggcgcaggctccaaagaagaagaaaccaaggcccagagagggaggcccaggtgcagggagcaggcgagggaaggatccgtacaggggcccaacactactccaccaaccgaagcccccaaaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctggtgagctgaggattctggaacgcggggggaaatgcccataagtttggaagttaagaaaaacacttctacatagagg

SEQ ID NO: 413 - DNA, 4194 bp, Homo sapiens
  ENST00000270328
gacccctccctgcccaggctccaaagaagaagaaaccaaggcccagagagggaggcccaggtgcagggagcaggcgagggaaggatccgtacaggggcccaacactactccaccaaccgaagcccccaaaaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgttgccaaacttttccaggactcgagtctgggaagcaccgttaacatcctcgtaactcgcctcatcctgctcacggaggaccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctggccacagcgttcaccattgcccacgagatcgggcacacattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagagtgcaaggatgtgaacaaggtcgcctactgccccctggtgctcaaatttcagttctgcagccgagcctacttccgccagatgtgctgcaaaacctgccatggccactagggggcgcgcggcacccggagccacagctggcggggtctccgccgccagccctgcagcgggccggccagagggggccccgggggggcgggaactgggagggaagggtgagacggagccggaagttatttattgggaacccctgcagggccctggctggggggatggagaggggctggctatccccccagagcccctcttcagcatccgccccttccagttcacatagtgagaccccccctccagggtgggtctggggaggggacagctgttcaccccagcaccctttgaacccacccttagggagtccccaacactccccccctcctttgatcggaatatgtactgtgaagagtaggggtggggaggtggtctgccggtgccctgccccccagcactgccctacccctccactccgagctgggggggaatctgtgtctgctatgggaggggggggggtagcaccacctccctgacaccctcccctgacctgactagggggaggatccaccccaacctctgccctgcccgccccaggggcaccccgacatccaggccaccccctcatggtgctacagaccctgccctggggcccacacactcctgccaggaagccctacatcaataaagttctgtcttgtgtagatttctacg

SEQ ID NO: 414 - DNA, 5673 bp, Homo sapiens
  ENST00000299164
atgcttctgctgggcatcctaaccctggctttcgccgggcgaaccgctggaggctctgagccagagcgggaggtagtcgttcccatccgactggacccggacattaacggccgccgctactactggcggggtcccgaggactccggggatcagggactcatttttcagatcacagcatttcaggaggacttttacctacacctgacgccggatgctcagttcttggctcccgccttctccactgagcatctgggcgtccccctccaggggctcaccgggggctcttcagacctgcgacgctgcttctattctggggacgtgaacgccgagccggactcgttcgctgctgtgagcctgtgcggggggctccgcggagcctttggctaccgaggcgccgagtatgtcattagcccgctgcccaatgctagcgcgccggcggcgcagcgcaacagccagggcgcacaccttctccagcgccggggtgttccgggcgggccttccggagaccccacctctcgctgcggggtggcctcgggctggaaccccgccatcctacgggccctggacccttacaagccgcggcgggcgggcttcggggagagtcgtagccggcgcaggtctgggcgcgccaagcgtttcgtgtctatcccgcggtacgtggagacgctggtggtcgcggacgagtcaatggtcaagttccacggcgcggacctggaacattatctgctgacgctgctggcaacggcggcgcgactctaccgccatcccagcatcctcaaccccatcaacatcgttgtggtcaaggtgctgcttcttagagatcgtgactccgggcccaaggtcaccggcaatgcggccctgacgctgcgcaacttctgtgcctggcagaagaagctgaacaaagtgagtgacaagcaccccgagtactgggacactgccatcctcttcaccaggcaggacctgtgtggagccaccacctgtgacaccctgggcatggctgatgtgggtaccatgtgtgaccccaagagaagctgctctgtcattgaggacgatgggcttccatcagccttcaccactgcccacgagctgggccacgtgttcaacatgccccatgacaatgtgaaagtctgtgaggaggtgtttgggaagctccgagccaaccacatgatgtccccgaccctcatccagatcgaccgtgccaacccctggtcagcctgcagtgctgccatcatcaccgacttcctggacagcgggcacggtgactgcctcctggaccaacccagcaagcccatctccctgcccgaggatctgccgggcgccagctacaccctgagccagcagtgcgagctggcttttggcgtgggctccaagccctgtccttacatgcagtactgcaccaagctgtggtgcaccgggaaggccaagggacagatggtgtgccagacccgccacttcccctgggccgatggcaccagctgtggcgagggcaagctctgcctcaaaggggcctgcgtggagagacacaacctcaacaagcacagggtggatggttcctgggccaaatgggatccctatggcccctgctcgcgcacatgtggtgggggcgtgcagctggccaggaggcagtgcaccaaccccacccctgccaacgggggcaagtactgcgagggagtgagggtgaaataccgatcctgcaatctggagccctgccccagctcagcctccggaaagagcttccgggaggagcagtgtgaggctttcaacggctacaaccacagcaccaaccggctcactctcgccgtggcatgggtgcccaagtactccggcgtgtctccccgggacaagtgcaagctcatctgccgagccaatggcactggctacttctatgtgctggcacccaaggtggtggacggcacgctgtgctctcctgactccacctccgtctgtgtccaaggcaagtgcatcaaggctggctgtgatgggaacctgggctccaagaagagattcgacaagtgtggggtgtgtgggggagacaataagagctgcaagaaggtgactggactcttcaccaagcccatgcatggctacaatttcgtggtggccatccccgcaggcgcctcaagcatcgacatccgccagcgcggttacaaagggctgatcggggatgacaactacctggctctgaagaacagccaaggcaagtacctgctcaacgggcatttcgtggtgtcggcggtggagcgggacctggtggtgaagggcagtctgctgcggtacagcggcacgggcacagcggtggagagcctgcaggcttcccggcccatcctggagccgctgaccgtggaggtcctctccgtggggaagatgacaccgccccgggtccgctactccttctatctgcccaaagagcctcgggaggacaagtcctctcatcccaaggacccccggggaccctctgtcttgcacaacagcgtcctcagcctctccaaccaggtggagcagccggacgacaggccccctgcacgctgggtggctggcagctgggggccgtgctccgcgagctgcggcagtggcctgcagaagcgggcggtggactgccggggctccgccgggcagcgcacggtccctgcctgtgatgcagcccatcggcccgtggagacacaagcctgcggggagccctgccccacctgggagctcagcgcctggtcaccctgctccaagagctgcggccggggatttcagaggcgctcactcaagtgtgtgggccacggaggccggctgctggcccgggaccagtgcaacttgcaccgcaagccccaggagctggacttctgcgtcctgaggccgtgctgagtggggtcatcgctttctccccctcactctccaccccactgatatgccagcgttctgccagctggagtagcgggcagaggacggtggccaggggctcacgccacgatgtcacccacatccggggacaaggaccatgggctggggcgagaggttccctcctcctccctggactgggcagagggaagcccaggaactcccgcacagtctacctcaggccccgctcctcgggccggttgcggggagaggctttgaggtgcagggcagaaggtgctgaggcccagtttccaaggaacttggaggatgggcaccttccaggcagaacttcagggaccccggcccccagaacggaggccacaggctgctggaagagccatgtcccagcagcttggcaccctcaggtggccccatgggctctgagccgtgtctgaacgaggcagggttttcacggtgcttttagcccactttcctttttgaactgacatggactaagcaataaaagctggctggggctgggcagaagccacggggagagtgagattagggcccctggagcctggcactccaccttggaagacgtggacgtgcacagggagtcccgaggtttctcatcctgcactcttggccctcctataaagaagcagcctctccttcctctgatgtgcagggtgtaggactagtggtagggctgccacggaagtgtcctctgaggctctgcaggtagcggggaaagccagtagggagtctgctgtcttcttcaagatggagccggccattacagaaagatgttgacatttgctaggggctatgcagtctgtggctgatgcagggagttttcagaaagttctggagggttctgctgtcactggactggggttggtgctgagctctgggcctggctttgggagatgtcaccctgggatagggaggaggaagctgcatttctaatggcttcctcctccagagaggcacgtatatgcaggctgacatccgagggtctgtgtcgcctcagacagccctgacagtggccacagtcccgtacccattgtgaggggctggggcatgcctaggagggctaggtgctgaacatctatgtgcctataaactcgtcttcgttccaaacagctactgctgtctgccctgggcacgtcacgttgcatcctaggccttagcttctccactgtttgctacctcagattatgccctctgggaacccagccgtatccctcccctaggacagtggtgacctggtccttccaccacactcagtctttggagagcgagctgtccagccacagaaatgagggtgtggtgcgtggcttcctgctccccacagcccagccccctgttggggctccaaagccgaagacagggcctcttcagactccttgggagtaggtttcaggaggcaccaagaatcaatgactgacccagggggcctggcagccactagtatgaactgctggagacctgtctgtcttatagacatgtcaggaaaatagaaacaggcattttctctagctccaagtggggagatattttggggtcacagcttctttggctaagcagggtgtttcttgaaggttcagatgccccactgtgtacatgggatattctgcttctgagtgtaggtgatgaatccaggtcctcagtggagaattttctggagctaagatcaaagcatgtgtcttcctgggagagaagagttccgttcttttatgtgggtttccctaatagtcagaatccacaaaccagccagccagccagccaagcctctgcgatgatgttctcatccggtctaacgctgggctggaaaccttggacagagttcatgcgggggcagagggggtgccagtctctgaggcagggctgcagtcacccctgaagaactaagtgaacaggaacccctctgtgccagtgaccactgtggggctaaagggacaaaaaggaccagggtaccaggcagaagcagatccttgatagctgacgacagcactgcgccctgtgcttggtgcactccctccttcaggaggagagggtggcatggggtctgtgcgggatggcagggggattgggtgggtgggaagagaggtgccatcggtaggaggctggcctccagtagaggagagcagcttttgccatcagtcactttacaaaccatttcaaggaaggacaacctctctggctcctgacacaagccaggcctcggtgcttttatctgttgtggtggtttttcttctttccctttttaaaagacgcatgaccaagacaacctagggagtttgtcttgcttgcctttgactatttccttaatccaaccatgctctcgagggctgagcagagactagactcaaggcacaggtttctggtgatggagtaaagttacagcggtatctcatgtctacacaagaagaggaacgttctgaaagctccaacaacttcttgagggggatggaccaatacagctttgggctcaggattccctagcctcctctgcccatcgcgtgcactgattggaggagtctggcccaaacactctcatatgaacctcgacatgctggagtggggtctggcaggagctgatgacagtttgagggacttgagtgtccctagcctggcagttggctcccggaagcactagacactgacactcattggtagaccctccctccccgccgttgtgtttggttcttttgcactccatgtactgcagaaggatggaaggacctgggtgctggctgggctgtgtatactgtgtatacaagggagctggctgctgaggtgaccacagccttctcctaataaagctgtaagtatttaaaa

SEQ ID NO: 415 - DNA, 2682 bp, Homo sapiens
  ENST00000511368
agtaataaccccggcgcggcggcggagtcgctgtggggaatcctcccgcgctctgcctgggtcgggtcctccctgcccgctcgcacgctgccggccggggaccctccggtggcccctagcccctcggagcgctcctggatgaagccccgcgcgcgcggatggcggggcttggcggcgctgtggatgctgttggcgcaggtggccgagcaggcacctgcgtgcgccatgggacccgcagcggcagcgcctgggagcccgagcgtcccgcgtcctcctccacccgcggagcggccgggctggatggaaaagggcgaatatgacctggtctctgcctacgaggttgaccacaggggcgattacgtgtcccatgaaatcatgcaccatcagcggcggagaagagcagtgcccgtgtccgaggttgagtctcttcaccttcggctgaaaggctccaggcacgacttccacatggatctgaggacttccagcagcctagtggctcctggctttattgtgcagacgttgggaaagacaggcactaagtctgtgcagactttaccgccagaggacttctgtttctatcaaggctctttgcgatcacacagaaactcctcagtggccctttcaacctgccaaggcttgtcaggcatgatacgaacagaagaggcagattacttcctaaggccacttccttcacacctctcatggaaactcggcagagctgcccaaggcagctcgccatcccacgtactgtacaagagatccacagagccccatgctcctggggccagtgaggtcctggtgacctcaaggacatgggagctggcacatcaacccctgcacagcagcgaccttcgcctgggactgccacaaaagcagcatttctgtggaagacgcaagaaatacatgccccagcctcccaaggaagacctcttcatcttgccagatgagtataagtcttgcttacggcataagcgctctcttctgaggtcccatagaaatgaagaactgaacgtggagaccttggtggtggtcgacaaaaagatgatgcaaaaccatggccatgaaaatatcaccacctacgtgctcacgatactcaacatggtatctgctttattcaaagatggaacaataggaggaaacatcaacattgcaattgtaggtctgattcttctagaagatgaacagccaggactggtgataagtcaccacgcagaccacaccttaagtagcttctgccagtggcagtctggattgatggggaaagatgggactcgtcatgaccacgccatcttactgactggtctggatatatgttcctggaagaatgagccctgtgacactttgggatttgcacccataagtggaatgtgtagtaaatatcgcagctgcacgattaatgaagatacaggtcttggactggccttcaccattgcccatgagtctggacacaactttggcatgattcatgatggagaagggaacatgtgcaaaaagtccgagggcaacatcatgtcccctacattggcaggacgcaatggagtcttctcctggtcaccctgcagccgccagtatctacacaaatttctaagcaccgctcaagctatctgccttgctgatcagccaaagcctgtgaaggaatacaagtatcctgagaaattgccaggagaattatatgatgcaaacacacagtgcaagtggcagttcggagagaaagccaagctctgcatgctggactttaaaaaggacatctgtaaagccctgtggtgccatcgtattggaaggaaatgtgagactaaatttatgccagcagcagaaggcacaatttgtgggcatgacatggtaagaagctaactgtaggtacagcatcgtattcagatgctagtctttcaacccatgcatctttgctcctcttgcataggtatttttaaaacatgtatttctcatatacatatgcatacccatgctcctatcaaacactgtgtttattttatattgataatgtgaagaggaatccttttctcacttttgtgaaaataaaattgatgagctacctggaattcatagacatagaaatcagacaacaggtgatgacagattcagtctattgaggggaaacattaagccattgaccaccatttatcatggaaaggaccagcattaaacagtgctgtgaaagccacagaacatcggtttgaagaccctggagcacatcattttcacctattgttgcctctgtgagaagagagagagctatggtagagaaaagaagaagtatacaagatgttgcagcaatgtggacgtagttggaggccattcattatcctaggcaaactaatgcaggaacagaaaaccaaatactgcatgttgttacttataagcaggagctaaacactgagtacacatggacacaaagatgggaaccatagaccccggggactacttaaggggggatggtgggagggggcaagggttgaaacactatcccatattgtgcttgctgcatgggtgatgaggttattcgaatgccaaactttagtgacacgtaatctacccatgtaacaaatctgcacatgtacccctgaacctaaaacaaaagtcggaaaaaaaagaaatatacaagataacaagtttattactaaatggtaaagaatgacaatttcattattaaaactttaaaaaatt

SEQ ID NO: 416 - DNA, 4979 bp, Homo sapiens
  ENST00000274181
agtaataaccccggcgcggcggcggagtcgctgtggggaatcctcccgcgctctgcctgggtcgggtcctccctgcccgctcgcacgctgccggccggggaccctccggtggcccctagcccctcggagcgctcctggatgaagccccgcgcgcgcggatggcggggcttggcggcgctgtggatgctgttggcgcaggtggccgagcaggcacctgcgtgcgccatgggacccgcagcggcagcgcctgggagcccgagcgtcccgcgtcctcctccacccgcggagcggccgggctggatggaaaagggcgaatatgacctggtctctgcctacgaggttgaccacaggggcgattacgtgtcccatgaaatcatgcaccatcagcggcggagaagagcagtgcccgtgtccgaggttgagtctcttcaccttcggctgaaaggctccaggcacgacttccacatggatctgaggacttccagcagcctagtggctcctggctttattgtgcagacgttgggaaagacaggcactaagtctgtgcagactttaccgccagaggacttctgtttctatcaaggctctttgcgatcacacagaaactcctcagtggccctttcaacctgccaaggcttgtcaggcatgatacgaacagaagaggcagattacttcctaaggccacttccttcacacctctcatggaaactcggcagagctgcccaaggcagctcgccatcccacgtactgtacaagagatccacagagccccatgctcctggggccagtgaggtcctggtgacctcaaggacatgggagctggcacatcaacccctgcacagcagcgaccttcgcctgggactgccacaaaagcagcatttctgtggaagacgcaagaaatacatgccccagcctcccaaggaagacctcttcatcttgccagatgagtataagtcttgcttacggcataagcgctctcttctgaggtcccatagaaatgaagaactgaacgtggagaccttggtggtggtcgacaaaaagatgatgcaaaaccatggccatgaaaatatcaccacctacgtgctcacgatactcaacatggtatctgctttattcaaagatggaacaataggaggaaacatcaacattgcaattgtaggtctgattcttctagaagatgaacagccaggactggtgataagtcaccacgcagaccacaccttaagtagcttctgccagtggcagtctggattgatggggaaagatgggactcgtcatgaccacgccatcttactgactggtctggatatatgttcctggaagaatgagccctgtgacactttgggatttgcacccataagtggaatgtgtagtaaatatcgcagctgcacgattaatgaagatacaggtcttggactggccttcaccattgcccatgagtctggacacaactttggcatgattcatgatggagaagggaacatgtgcaaaaagtccgagggcaacatcatgtcccctacattggcaggacgcaatggagtcttctcctggtcaccctgcagccgccagtatctacacaaatttctaagcaccgctcaagctatctgccttgctgatcagccaaagcctgtgaaggaatacaagtatcctgagaaattgccaggagaattatatgatgcaaacacacagtgcaagtggcagttcggagagaaagccaagctctgcatgctggactttaaaaaggacatctgtaaagccctgtggtgccatcgtattggaaggaaatgtgagactaaatttatgccagcagcagaaggcacaatttgtgggcatgacatgtggtgccggggaggacagtgtgtgaaatatggtgatgaaggccccaagcccacccatggccactggtcggactggtcttcttggtccccatgctccaggacctgcggagggggagtatctcataggagtcgcctctgcaccaaccccaagccatcgcatggagggaagttctgtgagggctccactcgcactctgaagctctgcaacagtcagaaatgtccccgggacagtgttgacttccgtgctgctcagtgtgccgagcacaacagcagacgattcagagggcggcactacaagtggaagccttacactcaagtagaagatcaggacttatgcaaactctactgtatcgcagaaggatttgatttcttcttttctttgtcaaataaagtcaaagatgggactccatgctcggaggatagccgtaatgtttgtatagatgggatatgtgagagagttggatgtgacaatgtccttggatctgatgctgttgaagacgtctgtggggtgtgtaacgggaataactcagcctgcacgattcacaggggtctctacaccaagcaccaccacaccaaccagtattatcacatggtcaccattccttctggagcccggagtatccgcatctatgaaatgaacgtctctacctcctacatttctgtgcgcaatgccctcagaaggtactacctgaatgggcactggaccgtggactggcccggccggtacaaattttcgggcactactttcgactacagacggtcctataatgagcccgagaacttaatcgctactggaccaaccaacgagacactgattgtggagctgctgtttcagggaaggaacccgggtgttgcctgggaatactccatgcctcgcttggggaccgagaagcagccccctgcccagcccagctacacttgggccatcgtgcgctctgagtgctccgtgtcctgcggagggggacagatgaccgtgagagagggctgctacagagacctgaagtttcaagtaaatatgtccttctgcaatcccaagacacgacctgtcacggggctggtgccttgcaaagtatctgcctgtcctcccagctggtccgtggggaactggagtgcctgcagtcggacgtgtggcgggggtgcccagagccgccccgtgcagtgcacacggcgggtgcactatgactcggagccagtcccggccagcctgtgccctcagcctgctccctccagcaggcaggcctgcaactctcagagctgcccacctgcatggagcgccgggccctgggcagagtgctcacacacctgtgggaaggggtggaggaagcgggcagtggcctgtaagagcaccaacccctcggccagagcgcagctgctgcccgacgctgtctgcacctccgagcccaagcccaggatgcatgaagcctgtctgcttcagcgctgccacaagcccaagaagctgcagtggctggtgtccgcctggtcccagtgctctgtgacatgtgaaagaggaacacagaaaagattcttaaaatgtgctgaaaagtatgtttctggaaagtatcgagagctggcctcaaagaagtgctcacatttgccgaagcccagcctggagctggaacgtgcctgcgccccgcttccatgccccaggcaccccccatttgctgctgcgggaccctcgaggggcagctggtttgcctcaccctggtctcagtgcacggccagctgtgggggaggcgttcagacgaggtccgtgcagtgcctggctgggggccggccggcctcaggctgcctcctgcaccagaagccttcggcctccctggcctgcaacactcacttctgccccattgcagagaagaaagatgccttctgcaaagactacttccactggtgctacctggtaccccagcacgggatgtgcagccacaagttctacggcaagcagtgctgcaagacttgctctaagtccaacttgtgagttgggaccgctctccgtagcagagaaagtgcctgcgtggcacagaaatttcccacaaatgagctgtgcaatctacgtcggaatacatccaaggaagagcaaagccaaaagaagaaaaccgtgttaggctctttgaccaggagtgtatgtatgtgtttcactgtgagcctgggtgcagacctgtgtccccatgcacacagtgtctcctgtcaggctgaaatgtggcaccctggcagacagagctgtggctcgtgaggcagaaggcaggcaccacaacgggagaggcagcactcacccctgcctgttgcagctaaatcaagtcaaaaagacaggcgaggctgaacttgctaaatgtctggtgccttagaaaaagaaggaaaggccatgaaataaggaaaacatacaaaatatgtaccccctagttcaccagcctcccctcccactaggagggcccctcgagccatcaggagtgaccaacttcctgggtggaggtcaggggagctccaggaggctgcccaggctcctcctcctcctccccagcggccgagcatctcttaccaggaacctggagccaccgccggagccagcgtcatctctagggtcactggccaggggactgcattctggtttgggactttgcctatggaaatgggaaaaatgaaattcctgctaaggtgcttctatctctttcagattcatgcattgaaggagagattttttatactttatgttttatctttctcagttatttgcaagtgagtgtccttttaaaaacacacttcttcatgcttttctttgtaaatgacagatcgaagtataggttacatcaaaaccctaccatcctgagaagagttatggttctattatagcagacgtcagccacacagcctatgtgacaataaccttagagtcctgtgttttgtttttgtgtgttgtgagattttaatcttttttttttcggtgagtctggccatttctataatgccaggtgggaagccaggctgcgggtgttagggtgggaatctgcccggcgtctctggcaccctccctgccatcctcagtgcggctgctgttctcctgtccggtgctgtggctccattccaaaggggcacctggatatttatatttgctgaagttttataataaagtttatatggtacagtgtg

SEQ ID NO: 417 - DNA, 3227 bp, Homo sapiens
  ENST00000433402
atgaagccccgcgcgcgcggatggcggggcttggcggcgctgtggatgctgttggcgcaggtggccgagcaggcacctgcgtgcgccatgggacccgcagcggcagcgcctgggagcccgagcgtcccgcgtcctcctccacccgcggagcggccgggctggatggaaaagggcgaatatgacctggtctctgcctacgaggttgaccacaggggcgattacgtgtcccatgaaatcatgcaccatcagcggcggagaagagcagtgcccgtgtccgaggttgagtctcttcaccttcggctgaaaggctccaggcacgacttccacatggatctgaggacttccagcagcctagtggctcctggctttattgtgcagacgttgggaaagacaggcactaagtctgtgcagactttaccgccagaggacttctgtttctatcaaggctctttgcgatcacacagaaactcctcagtggccctttcaacctgccaaggcttgtcaggcatgatacgaacagaagaggcagattacttcctaaggccacttccttcacacctctcatggaaactcggcagagctgcccaaggcagctcgccatcccacgtactgtacaagagatccacagagccccatgctcctggggccagtgaggtcctggtgacctcaaggacatgggagctggcacatcaacccctgcacagcagcgaccttcgcctgggactgccacaaaagcagcatttctgtggaagacgcaagaaatacatgccccagcctcccaaggaagacctcttcatcttgccagatgagtataagtcttgcttacggcataagcgctctcttctgaggtcccatagaaatgaagaactgaacgtggagaccttggtggtggtcgacaaaaagatgatgcaaaaccatggccatgaaaatatcaccacctacgtgctcacgatactcaacatggtatctgctttattcaaagatggaacaataggaggaaacatcaacattgcaattgtaggtctgattcttctagaagatgaacagccaggactggtgataagtcaccacgcagaccacaccttaagtagcttctgccagtggcagtctggattgatggggaaagatgggactcgtcatgaccacgccatcttactgactggtctggatatatgttcctggaagaatgagccctgtgacactttgggatttgcacccataagtggaatgtgtagtaaatatcgcagctgcacgattaatgaagatacaggtcttggactggccttcaccattgcccatgagtctggacacaactttggcatgattcatgatggagaagggaacatgtgcaaaaagtccgagggcaacatcatgtcccctacattggcaggacgcaatggagtcttctcctggtcaccctgcagccgccagtatctacacaaatttctaagcaccgctcaagctatctgccttgctgatcagccaaagcctgtgaaggaatacaagtatcctgagaaattgccaggagaattatatgatgcaaacacacagtgcaagtggcagttcggagagaaagccaagctctgcatgctggactttaaaaaggacatctgtaaagccctgtggtgccatcgtattggaaggaaatgtgagactaaatttatgccagcagcagaaggcacaatttgtgggcatgacatgtggtgccggggaggacagtgtgtgaaatatggtgatgaaggccccaagcccacccatggccactggtcggactggtcttcttggtccccatgctccaggacctgcggagggggagtatctcataggagtcgcctctgcaccaaccccaagccatcgcatggagggaagttctgtgagggctccactcgcactctgaagctctgcaacagtcagaaatgtccccgggacagtgttgacttccgtgctgctcagtgtgccgagcacaacagcagacgattcagagggcggcactacaagtggaagccttacactcaagtagaagatcaggacttatgcaaactctactgtatcgcagaaggatttgatttcttcttttctttgtcaaataaagtcaaagatgggactccatgctcggaggatagccgtaatgtttgtatagatgggatatgtgagagagttggatgtgacaatgtccttggatctgatgctgttgaagacgtctgtggggtgtgtaacgggaataactcagcctgcacgattcacaggggtctctacaccaagcaccaccacaccaaccagtattatcacatggtcaccattccttctggagcccggagtatccgcatctatgaaatgaacgtctctacctcctacatttctgtgcgcaatgccctcagaaggtactacctgaatgggcactggaccgtggactggcccggccggtacaaattttcgggcactactttcgactacagacggtcctataatgagcccgagaacttaatcgctactggaccaaccaacgagacactgattgtggagctgctgtttcagggaaggaacccgggtgttgcctgggaatactccatgcctcgcttggggaccgagaagcagccccctgcccagcccagctacacttgggccatcgtgcgctctgagtgctccgtgtcctgcggagggggacagatgaccgtgagagagggctgctacagagacctgaagtttcaagtaaatatgtccttctgcaatcccaagacacgacctgtcacggggctggtgccttgcaaagtatctgcctgtcctcccagctggtccgtggggaactggagtgcctgcagtcggacgtgtggcgggggtgcccagagccgccccgtgcagtgcacacggcgggtgcactatgactcggagccagtcccggccagcctgtgccctcagcctgctccctccagcaggcaggcctgcaactctcagagctgcccacctgcatggagcgccgggccctgggcagagtgctcacacacctgtgggaaggggtggaggaagcgggcagtggcctgtaagagcaccaacccctcggccagagcgcagctgctgcccgacgctgtctgcacctccgagcccaagcccaggatgcatgaagcctgtctgcttcagcgctgccacaagcccaagaagctgcagtggctggtgtccgcctggtcccaggtaggtgcactggtctcgcgggagcgaggttgactagctct

SEQ ID NO: 418 - DNA, 187 bp, Homo sapiens
  ENST00000513709
gtgagggctccactcgcactctgaagctctgcaacagtcagaaatgtccccgggacagtgttgacttccgtgctgctcagtgtgccgagcacaacagcagacgattcagagggcggcactacaagtggaagccttacactcaagtagaagagagttggatgtgacaatgtccttggatctgatgctg

SEQ ID NO: 419 - DNA, 6207 bp, Homo sapiens
  ENST00000268070
aattactttttccaaaggctggagggcttcactccggctggcgccgccgcctagcgcgctcctgcttcgccgccacggtccgggggggctgccggtcccgggtaccatgtgtgacggcgccctgctgcctccgctcgtcctgcccgtgctgctgctgctggtttggggactggacccgggcacagctgtcggcgacgcggcggccgacgtggaggtggtgctcccgtggcgggtgcgccccgacgacgtgcacctgccgccgctgcccgcagcccccgggccccgacggcggcgacgcccccgcacgcccccagccgccccgcgcgcccggcccggagagcgcgccctgctgctgcacctgccggccttcgggcgcgacctgtaccttcagctgcgccgcgacctgcgcttcctgtcccgaggcttcgaggtggaggaggcgggcgcggcccggcgccgcggccgccccgccgagctgtgcttctactcgggccgtgtgctcggccaccccggctccctcgtctcgctcagcgcctgcggcgccgccggcggcctggttggcctcattcagcttgggcaggagcaggtgctaatccagcccctcaacaactcccagggcccattcagtggacgagaacatctgatcaggcgcaaatggtccttgacccccagcccttctgctgaggcccagagacctgagcagctctgcaaggttctaacagaaaagaagaagccgacgtggggcaggccttcgcgggactggcgggagcggaggaacgctatccggctcaccagcgagcacacggtggagaccctggtggtggccgacgccgacatggtgcagtaccacggggccgaggccgcccagaggttcatcctgaccgtcatgaacatggtatacaatatgtttcagcaccagagcctggggattaaaattaacattcaagtgaccaagcttgtcctgctacgacaacgtcccgctaagttgtccattgggcaccatggtgagcggtccctggagagcttctgtcactggcagaacgaggagtatggaggagcgcgatacctcggcaataaccaggttcccggcgggaaggacgacccgcccctggtggatgctgccgtgtttgtgaccaggacagatttctgtgtacacaaggatgaaccgtgtgacactgttggaattgcttacttaggaggtgtgtgcagtgctaagaggaagtgtgtgcttgccgaagacaatggtctcaatttggcctttaccatcgcccatgagctgggccacaacttgggcatgaaccacgacgatgaccactcatcttgcgctggcaggtcccacatcatgtcaggagagtgggtgaaaggccggaacccaagtgacctctcttggtcctcctgcagccgagatgaccttgaaaacttcctcaagtcaaaagtcagcacctgcttgctagtcacggaccccagaagccagcacacagtacgcctcccgcacaagctgccgggcatgcactacagtgccaacgagcagtgccagatcctgtttggcatgaatgccaccttctgcagaaacatggagcatctaatgtgtgctggactgtggtgcctggtagaaggagacacatcctgcaagaccaagctggaccctcccctggatggcaccgagtgtggggcagacaagtggtgccgcgcgggggagtgcgtgagcaagacgcccatcccggagcatgtggacggagactggagcccgtggggcgcctggagcatgtgcagccgaacatgtgggacgggagcccgcttcaggcagaggaaatgtgacaaccccccccctgggcctggaggcacacactgcccgggtgccagtgtagaacatgcggtctgcgagaacctgccctgccccaagggtctgcccagcttccgggaccagcagtgccaggcacacgaccggctgagccccaagaagaaaggcctgctgacagccgtggtggttgacgataagccatgtgaactctactgctcgcccctcgggaaggagtccccactgctggtggccgacagggtcctggacggtacaccctgcgggccctacgagactgatctctgcgtgcacggcaagtgccagaaaatcggctgtgacggcatcatcgggtctgcagccaaagaggacagatgcggggtctgcagcggggacggcaagacctgccacttggtgaagggcgacttcagccacgcccgggggacagctctcaaagactcgggtaaggggtccatcaacagtgactggaagatagagctccccggagagttccagattgcaggcacaactgttcgctatgtgagaagggggctgtgggagaagatctctgccaagggaccaaccaaactaccgctgcacttgatggtgttgttatttcacgaccaagattatggaattcattatgaatacactgttcctgtaaaccgcactgcggaaaatcaaagcgaaccagaaaaaccgcaggactctttgttcatctggacccacagcggctgggaagggtgcagtgtgcagtgcggcggaggggagcgcagaaccatcgtctcgtgtacacggattgtcaacaagaccacaactctggtgaacgacagtgactgccctcaagcaagccgcccagagccccaggtccgaaggtgcaacttgcacccctgccagtcacggtgggtggcaggcccgtggagcccctgctcggcgacctgtgagaaaggcttccagcaccgggaggtgacctgcgtgtaccagctgcagaacggcacacacgtcgctacgcggcccctctactgcccgggcccccggccggcggcagtgcagagctgtgaaggccaggactgcctgtccatctgggaggcgtctgagtggtcacagtgctctgccagctgtggtaaaggggtgtggaaacggaccgtggcgtgcaccaactcacaagggaaatgcgacgcatccacgaggccgagagccgaggaggcctgcgaggactactcaggctgctacgagtggaaaactggggactggtctacgtgctcgtcgacctgcgggaagggcctgcagtcccgggtggtgcagtgcatgcacaaggtcacagggcgccacggcagcgagtgccccgccctctcgaagcctgccccctacagacagtgctaccaggaggtctgcaacgacaggatcaacgccaacaccatcacctccccccgccttgctgctctgacctacaaatgcacacgagaccagtggacggtatattgccgggtcatccgagaaaagaacctctgccaggacatgcggtggtaccagcgctgctgccagacctgcagggacttctatgcaaacaagatgcgccagccaccgccgaactcgtgacacgcagtcccaagggtcgctcaaagctcagactcaggtctgaaacccacccacccgcaagcctaccagccttgtggccacgcccccacccggctgccacaagaatccaactacatagaacatgagcgtggacttggcgtttgccattagtgcttccgtacttaatatattgttaacagccactggctggctttctacagtgaggagaaagtaggcatgagtcacaaagtaacttcaatttctaggatttcaggtacctcgaagggaagcacctctggcagacaaccgtcaagagagagacatcatttagtgttcttgtcttgactcgcttttgacatttgaatttccagtgcttggtatatcatggaggaaacatccccaaaacgagacatgctagaaaaggctttattctgaaagccggcgacaccatggagggaggggcaggtgttggtgagcctctgcccgtggcttctctggggagggccgggctgcttagcacacgtttctctccatctaccttcttgaccacatgagaaccaggacgttgcctccatgcccgtctctgagaacatagtctctaaatcctaggtgttgccttggaagtctcgtgcgtggagtgtaaatctatatatgccagcgaggacagcagtgccacgcagttcataccacccgcatgggaagaatgttccaagagagtctgggtttggggaagcatctaattttcagagctctgctgtccaccgtgtagggaaacagaagggcctctcttcaaggtgctgtgacataagaaacggtaattgcggtgatggggttgcttcctaaggcaaaggtaagcttgggccagcttcactggggcggatgggcacctgccccgccttccgggaacatccactctggcctgcacttcctaaagctttgtaccttagagatgctgtaccacatcccagtggctttctaccgaccgtggccatttatctgaaggtaagacgacatttgggacctctgaggacacaagcccaggcctaggatctgtagagcaaggcctgactgctctatcctggcacggagcagcctgatgtgccaggaccaggggaggaacgccatctggctggcactgctgcacacccgccgagccttcctgtagccccagactttgtggtacccattatcatcacgcctgtcatcattgacccatcttcttggtggggcaaggatgatgcatgatgaaggaaggtccttcccccctgcagcccccttacgcctggcagcagacaagcagagtggcctctttgagagcacagaggatggtagcaccctacctgcaaggaggccgggcagggaccctagatgccaggaggcctgttttgctcaccaacttggtgggcatttcatgggtgcttatgttctaggactttaccgtaaataacacctcctccctgatttcagacggaaggtctcacttggacttccatgggatcatctccctgtgcttcttgatttattggtgctgtgtttctgtgttttgttttgttacatgtcacaaccgtagagttagcttaaatcagaaagaagcctctctgccttctccaccctgtcttacgagctgtgtttttgtttttactaccctagaggcagagaagcggtagggatgtcagggaatttactcacttccacttgaatcaacgagaagtgttgagaaacttccgtgggtgctctgtggaaagaaccgagggtgtcaggatggagcggcccaccctcgccccgcggcctgcgcagactgctgtcctccccttcaggcctggccaccagcagactcccatgaattcccattttcacaaagccctcaaaattttgggggcgctgaggttcaattttcttcatccccaaatgaactgttaattcactgaaagacatttagacttttgcagccaaggagcagagccgggcaagctcactaaggaagccttagcttggtctcctgcatgggccccggggcctccagatatgcccactgtcaccctggcaagggccccacaccctcagaatgaaaaggattgattgggttattgtcagatacccccattagttcccctaaagtctgcatctgcagagctcttttagctcatctttttgttgtcggtgttgttttttgagacagagtctccctctgttgcccaggctggagtgcagtggcgcgatctcagctcattgaaagctccgcctcccgggttcaggccattcttctgcctcaccctccccagtagctgggactacaggcgcccaccaccacgcccacctacttttttgtatttttactagagacggggtttcaccatgttagccaggatggtctcgatctcctgacctcatgatccacccgcctcagccttccaaagtgctgggattacaggagtgagccaccgcgcccggccttttagcttatcttgaaatccaccagcctaccttctgttcatggcacgagcagtgatttcagtgaaaccatcataaacattcttgttccactagatgctgatcacagcagtgatgtttctgtgttaataccctgtactgtccctcgagtactgtacctttgtgcttgcacacgtgtcactaacgcacgtgttaccagagtctcacgaccctacggtgctatttttattggtgcaaaattaaaccctctcagctgaccgttgctggataggatcagaatgcaggaaaagagcctctatggcaatacgattgtccttttttcgtttcagagtcaaatgtatctattttccattcgttaacttgcattacatactgtacccatg

SEQ ID NO: 420 - DNA, 1745 bp, Homo sapiens
  ENST00000557896
atcatcccagtcccttgacctcatgtcagccccactcaggctgtcctgtctctgcagtgctcgtcgacctgcgggaagggcctgcagtcccgggtggtgcagtgcatgcacaaggtcacagggcgccacggcagcgagtgccccgccctctcgaagcctgccccctacagacagtgctaccaggaggtctgcaacgacaggatcaacgccaacaccatcacctccccccgccttgctgctctgacctacaaatgcacacgagaccagtggacggtatattgccgggtcatccgagaaaagaacctctgccaggacatgcggtggtaccagcgctgctgccagacctgcagggacttctatgcaaacaagatgcgccagccaccgccgaactcgtgacacgcagtcccaagggtcgctcaaagctcagactcaggtctgaaacccacccacccgcaagcctaccagccttgtggccacgcccccacccggctgccacaagaatccaactacatagaacatgagcgtggacttggcgtttgccattagtgcttccgtacttaatatattgttaacagccactggctggctttctacagtgaggagaaagtaggcatgagtcacaaagtaacttcaatttctaggatttcaggtacctcgaagggaagcacctctggcagacaaccgtcaagagagagacatcatttagtgttcttgtcttgactcgcttttgacatttgaatttccagtgcttggtatatcatggaggaaacatccccaaaacgagacatgctagaaaaggctttattctgaaagccggcgacaccatggagggaggggcaggtgttggtgagcctctgcccgtggcttctctggggagggccgggctgcttagcacacgtttctctccatctaccttcttgaccacatgagaaccaggacgttgcctccatgcccgtctctgagaacatagtctctaaatcctaggtgttgccttggaagtctcgtgcgtggagtgtaaatctatatatgccagcgaggacagcagtgccacgcagttcataccacccgcatgggaagaatgttccaagagagtctgggtttggggaagcatctaattttcagagctctgctgtccaccgtgtagggaaacagaagggcctctcttcaaggtgctgtgacataagaaacggtaattgcggtgatggggttgcttcctaaggcaaagagatgctgtaccacatcccagtggctttctaccgaccgtggccatttatctgaaggtaagacgacatttgggacctctgaggacacaagcccaggcctaggatctgtagagcaaggcctgactgctctatcctggcacggagcagcctgatgtgccaggaccaggggaggaacgccatctggctggcactgctgcacacccgccgagccttcctgtagccccagactttgtggtacccattatcatcacgcctgtcatcattgacccatcttcttggtggggcaaggatgatgcatgatgaaggaaggtccttcccccctgcagcccccttacgcctggcagcagacaagcagagtggcctctttgagagcacagaggatggtagcaccctacctgcaaggaggccgggcagggaccctagatgccaggaggcctgttttgctcaccaacttggtgggcatttcatgggtgcttatgttctaggactttaccgtaaataacacctcctccctgatttcag

SEQ ID NO: 421 - DNA, 643 bp, Homo sapiens
  ENST00000568565
gtgaactctactgctcgcccctcgggaaggagtccccactgctggtggccgacagggtcctggacggtacaccctgcgggccctacgagactgatctctgcgtgcacggcaagtgccagaaaatcggctgtgacggcatcatcgggtctgcagccaaagaggacagatgcggggtctgcagcggggacggcaagacctgccacttggtgaagggcgacttcagccacgcccgggggacaggttatatcgaagctgccgtcattcctgctggagctcggaggatccgtgtggtggaggataaacctgcccacagctttctggctctcaaagactcgggtaaggggtccatcaacagtgactggaagatagagctccccggagagttccagattgcaggcacaactgttcgctatgtgagaagggggctgtgggagaagatctctgccaagggaccaaccaaactaccgctgcacttgatggtgttgttatttcacgaccaagattatggaattcattatgaatacactgttcctgtaaaccgcactgcggaaaatcaaagcgaaccagaaaaaccgcaggactctttgttcatctggacccacagcggctgggaagggtgcagtgtgcagtgcggcggaggtga

SEQ ID NO: 422 - DNA, 1964 bp, Homo sapiens
  ENST00000378898
agtgtgtgccagtggcggttgtacctctaagacttcagcttttaaattcctgccggagcagacacttctgttgtttagtctgccttgttcatcccgttcgtgtgagctggacattggacacttccccctctgttggcctcattcagcttgggcaggagcaggtgctaatccagcccctcaacaactcccagggcccattcagtggacgagaacatctgatcaggcgcaaatggtccttgacccccagcccttctgctgaggcccagagacctgagcagctctgcaaggttctaacagaaaagaagaagccgacgtggggcaggccttcgcgggactggcgggagcggaggaacgctatccggctcaccagcgagcacacggtggagaccctggtggtggccgacgccgacatggtgcagtaccacggggccgaggccgcccagaggttcatcctgaccgtcatgaacatggtatacaatatgtttcagcaccagagcctggggattaaaattaacattcaagtgaccaagcttgtcctgctacgacaacgtcccgctaagttgtccattgggcaccatggtgagcggtccctggagagcttctgtcactggcagaacgaggagtatggaggagcgcgatacctcggcaataaccaggttcccggcgggaaggacgacccgcccctggtggatgctgccgtgtttgtgaccaggacagatttctgtgtacacaaggatgaaccgtgtgacactgttggaattgcttacttaggaggtgtgtgcagtgctaagaggaagtgtgtgcttgccgaagacaatggtctcaatttggcctttaccatcgcccatgagctgggccacaacttgggcatgaaccacgacgatgaccactcatcttgcgctggcaggtcccacatcatgtcaggagagtgggtgaaaggccggaacccaagtgacctctcttggtcctcctgcagccgagatgaccttgaaaacttcctcaagtcaaaagtcagcacctgcttgctagtcacggaccccagaagccagcacacagtacgcctcccgcacaagctgccgggcatgcactacagtgccaacgagcagtgccagatcctgtttggcatgaatgccaccttctgcagaaacatggagcatctaatgtgtgctggactgtggtgcctggtagaaggagacacatcctgcaagaccaagctggaccctcccctggatggcaccgagtgtggggcagacaagtggtgccgcgcgggggagtgcgtgagcaagacgcccatcccggagcatgtggacggagactggagcccgtggggcgcctggagcatgtgcagccgaacatgtgggacgggagcccgcttcaggcagaggaaatgtgacaaccccccccctgggcctggaggcacacactgcccgggtgccagtgtagaacatgcggtctgcgagaacctgccctgccccaagggtctgcccagcttccgggaccagcagtgccaggcacacgaccggctgagccccaagaagaaaggcctgctgacagccgtggtggttgacgataagccatgtgaactctactgctcgcccctcgggaaggagtccccactgctggtggccgacagggtcctggacggtacaccctgcgggccctacgagactgatctctgcgtgcacggcaagtgccagaaaatcggctgtgacggcatcatcgggtctgcagccaaagaggacagatgcggggtctgcagcggggacggcaagacctgccacttggtgaagggcgacttcagccacgcccgggggacaggttatatcgaagctgccgtcattcctgctggagctcggaggatccgtgtggtggaggataaacctgcccacagctttctgggtaaaacacaaatgacttgactcaccatttatgtgttgagaatcgattttgatgatcagtctggt

SEQ ID NO: 423 - DNA, 496 bp, Homo sapiens
  ENST00000559976
ggtggatgctgccgtgtttgtgaccaggacagatttctgtgtacacaaggatgaaccgtgtgacactgttggaattgcttacttaggaggtgtgtgcagtgctaagaggaagtgtgtgcttgccgaagacaatggtctcaatttggcctttaccatcgcccatgagctgggccacaacactccgcaagaaacagatactgaagacttggagtggctgtagacttccctaaaactgaggaattgctctccacgtacacatgatttttgctacgcactgttagcagcaagttcctcctcgacacctggagggttgactgttagcctggggttttcatcttcaggagcttttagccatctttccatttcctgccctgtcccagccctgtgtctgcagcaccattagatgaattactctctaggctcagaagcagaaagcatattcttattctcaccaaatcgccctgtttccttcaacaaagttccatgataactgaca

SEQ ID NO: 424 - DNA, 847 bp, Homo sapiens
  ENST00000560486
caagtgaccaagcttgtcctgctacgacaacgtcccgctaagttgtccattgggcaccatggtgagcggtccctggagagcttctgtcactggcagaacgaggagtatggaggagcgcgatacctcggcaataaccaggttcccggcgggaaggacgacccgcccctggtggatgctgccgtgtttgtgaccaggctgtggtcaagccggacagtgtattctccaagacgttccctgacaaacaggtggctaggtggctgccatggaggacgtgagcatgacatgtctagcaggagctgctgagccagaagcggttgaagctgggttttctgcagctgtgtctgggacttggaaggacccctgagtggactgggcctggggtcacacggagcccacacagaagccagggcttagggggcttcagcacctgggggggcttcaccttggcctccacatctgacccagaaagctgagaacgcagagaactcctccctgaagtcgagaactcctcctcgagcctgggcctgtgctctgggtgagagtgcctgggagacaccatagcagacacagctggcccgaagctgcaccaccaggatccctctggccagaccttcccctccagcataataccatctaactcctcggggcacccttccctttaccttctgccaggggaccctcttgccaggctttgcgcgtggtgaagcctcagcaagtatccatggaacttgatgttacgctcccaggcttcccacgctcgtgaggccatggctgctgggtagcttgcagggccccttgaaagggtctggaaacgtcagtcaattaataaacgaatgtattaagtccc

SEQ ID NO: 425 - DNA, 571 bp, Homo sapiens
  ENST00000558960
aattactttttccaaaggctggagggcttcactccggctggcgccgccgcctagcgcgctcctgcttcgccgccacggtccgggggggctgccggtcccgggtaccatgtgtgacggcgccctgctgcctccgctcgtcctgcccgtgctgctgctgctggtttggggactggacccgggcacaggttggcctcattcagcttgggcaggagcaggtgctaatccagcccctcaacaactcccagggcccattcagtggacgagaacatctgatcaggcgcaaatggtccttgacccccagcccttctgctgaggcccagagacctgagcagctctgcaaggttctaacagaaaagaagaagccgacgtggggcaggccttcgcgggactggcgggagcggaggaacgctatccggctcaccagcgagcacacggtggagaccctggtggtggccgacgccgacatggtgcagtaccacggggccgaggccgcccagaggttcatcctgaccgtcatgaacatggtatacaatatgtttcagcaccagagcctggggattaaaattaacat

SEQ ID NO: 426 - DNA, 954 bp, Homo sapiens
  ENST00000561355
gcggccgccccgccgagctgtgcttctactcgggccgtgtgctcggccaccccggctccctcgtctcgctcagcgcctgcggcgccgccggcggcctggttggcctcattcagcttgggcaggagcaggtgctaatccagcccctcaacaactcccagggcccattcagtggacgagaacatctgatcaggcgcaaatggtccttgacccccagcccttctgctgaggcccagagacctgagcagctctgcaaggttctaacagttccacagtgtctgggcctcacctgggaggacttgaaatctggaggctggagtgatctggaggtgcctcattcatgtgtctggcctggaggtggatgacttgaagacaaggacaacaacgtggagcgtctacctgtggcctctgcagcttggcgtccataccttggtggcagacatacttcttctatggccaccagggctcccaatgcaagagttcccgcaagcccagcaggagctgtgctgcctttgaggatcagcctcagaaatcctagagcatcactctgaaggtactctgttggctgaagcggttagaaacctacccaggttcaagggcagagagatagaccccaccgctcaatgtcaaagaatttgggggccttatttaaaacctcttcacacctctataactgtaggtaggtgacaccgctagtgacaaagggctactgtgcagagggatcagagacagctcgaggagagagcatattccatagttcagagacagcataccgggtatggggctcttcagcccagctttggacattggtgtgcatcaactgtgggcattgggcctagagaaggctttggtgtcagagctgtggtgtagtcactctgagtgtccttggtcagttaattgattatagctttacggagataaaattaacatgcaataaactgaatatattcaaatgta

SEQ ID NO: 427 - DNA, 220 bp, Homo sapiens
  ENST00000558930
ctgtcccgaggcttcgaggtggaggaggcgggcgcggcccggcgccgcggccgccccgccgagctgtgcttctactcgggccgtgtgctcggccaccccggctccctcgtctcgctcagcgcctgcggcgccgccggcggcctggtactgcccgcgccacctccgggtcggcccgtccggttggcctcattcagcttgggcaggagcaggtgctaatcca

SEQ ID NO: 428 - DNA, 349 bp, Homo sapiens
  ENST00000562332
agcaaggccggccttcctcaagttgtctgctccatcagaaacctccggtgctacgagcctgtaatacaaacttctgtccagctcctgaaaagagagattctgcaggaagccagttaccatgttgtgatggtcctcaagcagtccatgaagaaggactgaggtttcctgacaaccactgggctatgtgagaaagccttccagaagcagattccccagcccagccgagtattcagataactacagccccacctccaatctttcttgcagcctgatgagagacctcaagccagaaccacacagctaaccatttctgaatttccatgcaataaatgcataatgttataagcca

SEQ ID NO: 429 - DNA, 5913 bp, Homo sapiens
  ENST00000282849
aatcaccgcgcggtggagaggcgggcgctcggctccggcgcgctgggggagccagctggcgctgtcttccccatcgcctcagacgctcacaccgacacagacagacgcacagacgggcgggcagacaccgacagtctcccaaccgtttgcgctccagtcccggcccagggagccccccgtaccctctggggtgccgcaaactgcagctcggcaggcccgcgccgggagaagggagggcgcgcaggcggccggaggaggggaggtcccagcgcgcccccgctgcgatgtgaacggcggcggctctcacctggagccgcacctggggcgccgagctccggggccgcggaaagaatgcgcgccgcccgtgcgctccgcctgccgcgtctggccacccgcagccgccgcgtccgcacctgaccatggagtgcgccctcctgctcgcgtgtgccttcccggctgcgggttcgggcccgccgaggggcctggcgggactggggcgcgtggccaaggcgctccagctgtgctgcctctgctgtgcgtcggtcgccgcggccttagccagtgacagcagcagcggcgccagcggattaaatgatgattacgtctttgtcacgccagtagaagtagactcagccgggtcatatatttcacacgacattttgcacaacggcaggaaaaagcgatcggcgcagaatgccagaagctccctgcactaccgattttcagcatttggacaggaactgcacttagaacttaagccctcggcgattttgagcagtcactttattgtccaggtacttggaaaagatggtgcttcagagactcagaaacccgaggtgcagcaatgcttctatcagggatttatcagaaatgacagctcctcctctgtcgctgtgtctacgtgtgctggcttgtcaggtttaataaggacacgaaaaaatgaattcctcatctcgccattacctcagcttctggcccaggaacacaactacagctcccctgcgggtcaccatcctcacgtactgtacaaaaggacagcagaggagaagatccagcggtaccgtggctaccccggctctggccggaattatcctggttactccccaagtcacattccccatgcatctcagagtcgagagacagagtatcaccatcgaaggttgcaaaagcagcatttttgtggacgacgcaagaaatatgctcccaagcctcccacagaggacacctatctaaggtttgatgaatatgggagctctgggcgacccagaagatcagctggaaaatcacaaaagggcctcaatgtggaaaccctcgtggtggcagacaagaaaatggtggaaaagcatggcaagggaaatgtcaccacatacattctcacagtaatgaacatggtttctggcctatttaaagatgggactattggaagtgacataaacgtggttgtggtgagcctaattcttctggaacaagaacctggaggattattgatcaaccatcatgcagaccagtctctgaatagtttttgtcaatggcagtctgccctcattggaaagaatggcaagagacatgatcatgccatcttactaacaggatttgatatttgttcttggaagaatgaaccatgtgacactctagggtttgcccccatcagtggaatgtgctctaagtaccgaagttgtaccatcaatgaggacacaggacttggccttgccttcaccatcgctcatgagtcagggcacaactttggtatgattcacgatggagaagggaatccctgcagaaaggctgaaggcaatatcatgtctcccacactgaccggaaacaatggagtgttttcatggtcttcctgcagccgccagtatctcaagaaattcctcagcacacctcaggcggggtgtctagtggatgagcccaagcaagcaggacagtataaatatccggacaaactaccaggacagatttatgatgctgacacacagtgtaaatggcaatttggagcaaaagccaagttatgcagccttggttttgtgaaggatatttgcaaatcactttggtgccaccgagtaggccacaggtgtgagaccaagtttatgcccgcagcagaagggaccgtttgtggcttgagtatgtggtgtcggcaaggccagtgcgtaaagtttggggagctcgggccccggcccatccacggccagtggtccgcctggtcgaagtggtcagaatgttcccggacatgtggtggaggagtcaagttccaggagagacactgcaataaccccaagcctcagtatggtggcttattctgtccaggttctagccgtatttatcagctgtgcaatattaacccttgcaatgaaaatagcttggattttcgggctcaacagtgtgcagaatataacagcaaacctttccgtggatggttctaccagtggaaaccctatacaaaagtggaagaggaagatcgatgcaaactgtactgcaaggctgagaactttgaatttttttttgcaatgtccggcaaagtgaaagatggaactccctgctccccaaacaaaaatgatgtttgtattgacggggtttgtgaactagtgggatgtgatcatgaactaggctctaaagcagtttcagatgcttgtggcgtttgcaaaggtgataattcaacttgcaagttttataaaggcctgtacctcaaccagcataaagcaaatgaatattatccggtggtcctcattccagctggcgcccgaagcatcgaaatccaggagctgcaggtttcctccagttacctcgcagttcgaagcctcagtcaaaagtattacctcaccgggggctggagcatcgactggcctggggagttccccttcgctgggaccacgtttgaataccagcgctctttcaaccgcccggaacgtctgtacgcgccagggcccacaaatgagacgctggtctttgaaattctgatgcaaggcaaaaatccagggatagcttggaagtatgcacttcccaaggtcatgaatggaactccaccagccacaaaaagacctgcctatacctggagtatcgtgcagtcagagtgctccgtctcctgtggtggaggttacataaatgtaaaggccatttgcttgcgagatcaaaatactcaagtcaattcctcattctgcagtgcaaaaaccaagccagtaactgagcccaaaatctgcaacgctttctcctgcccggcttactggatgccaggtgaatggagtacatgcagcaaggcctgtgctggaggccagcagagccgaaagatccagtgtgtgcaaaagaagcccttccaaaaggaggaagcagtgttgcattctctctgtccagtgagcacacccactcaggtccaagcctgcaacagccatgcctgccctccacaatggagccttggaccctggtctcagtgttccaagacctgtggacgaggggtgaggaagcgtgaactcctctgcaagggctctgccgcagaaaccctccccgagagccagtgtaccagtctccccagacctgagctgcaggagggctgtgtgcttggacgatgccccaagaacagccggctacagtgggtcgcttcttcgtggagcgagtgttctgcaacctgtggtttgggtgtgaggaagagggagatgaagtgcagcgagaagggcttccagggaaagctgataactttcccagagcgaagatgccgtaatattaagaaaccaaatctggacttggaagagacctgcaaccgacgggcttgcccagcccatccagtgtacaacatggtagctggatggtattcattgccgtggcagcagtgcacagtcacctgtgggggaggggtccagacccggtcagtccactgtgttcagcaaggccggccttcctcaagttgtctgctccatcagaaacctccggtgctacgagcctgtaatacaaacttctgtccagctcctgaaaagagagaggatccatcctgcgtagatttcttcaactggtgtcacctagttcctcagcatggtgtctgcaaccacaagttttacggaaaacaatgctgcaagtcatgcacaaggaagatctgatcttggtgtcctccccagcaccttagggccaggggcttacctttcaacctctagagagaccagctgcctttgagaccaggagctgagcaccgagaaccatctgtgagctgccgctgtgatgaaggagcctgctctgaggaacagacaggttgccagtaggcttctagctcaattccctgaagcacgtggtactctgaagcacttgaaaatgggaagcgatgacaaatctgactttaaaaaaaatctttgatttgcactgttatatgcaagaagtggtgaatcacactgagatacgtcgatttggggagagacccccttttgaacttcaaagggttcaagggcaaagacatctgttttaaaaaggtcctttatgacttcaggtcaaagactgagactcagaactttcaaatctggatggaataccttgcctaactgttgcgtggagttcacagttcgactaaccctgtgaacacccaagccaggagttctatgagaagccaaatggtgctcgcaattgtgcttgctgctggactggcaagcttcatgttatgtttatttggtgtgcgtgtgtctttattattttgtgtaaactatattctgcttatagagagtctctgagactaaaattgacaacttgaaaagtattccaaggaatattatgaaaatagggcaacatggactgtttaagatctccatgtaattgaaattcatgcaaggaaacaactcatagaaaagataaatatggatgcccttcacatgttatcaacctcgtaacttttggtgcttgctgaatcagtccatgaaaagctacagcccgctctttgggaatgctacatacccatttctggtatttaaaaaatatctaggaggagctaaatgacaaaacacagcagtgttttgagggagaaaggaccatcatttataatgctctgtacatactaccagagctgcttggaaaattaaaggccacttgtggctttttcctaccaactgatacgtttaaatttgccctaggattgagctaacagcaaaaaaaaaaaaaaaaaaaagagagaaagaaaggagtaaacagtggtaataaaaaaatccatctgtcttcttgctatgttaatattaataaatcataatatgacaagaccctcactgaataagagtattttcagtcatcagaagccagctgttggtaggcattaatgagtttaaaattgttctcaattgaaaaaacatcacactattttgccaaaaccaaagtaattataatactgtgtcctcctgtaattttttgagaagtggttataaagggcatatttacataaattctactttattcctcaacttctttgatgaatgtaacccaattttacttctttaaaaagtctcaattcaagctggattagccagctcagcataatcaactagacagtggtttgttaaatttagcagcatacttcgttcccattctaattaaagtcatgagttcttgaatcccagagaaataatgcttaggaacttctctcaatctgcttggcttggcctagagaagtggccattttatcaacaggaaaaaaaaaaattttctctactacaaccccgttgccttctgaaaaacagcaagttatttctttatataattatcattttattattttatggaaaattaatttattaattaatagcctattatgtgttctcacttgcttctctaagtaatattttgagataaaatgttgaataaaaccatggattatagagaaaagtcaaaatatatgtgtaatatttaattattttataagttttataataaagtattccatttctttatctttga

SEQ ID NO: 430 - DNA, 669 bp, Homo sapiens
  ENST00000568393
gataattcaacttgcaagttttataaaggcctgtacctcaaccagcataaagcaaatgaatattatccggtggtcctcattccagctggcgcccgaagcatcgaaatccaggagctgcaggtttcctccagttacctcgcagttcgaagcctcagtcaaaagtattacctcaccgggggctggagcatcgactggcctggggagttccccttcgctgggaccacgtttgaataccagcgctctttcaaccgcccggaacgtctgtacgcgccagggcccacaaatgagacgctggtctttgaaattctgatgcaaggcaaaaatccagggatagcttggaagtatgcacttcccaaggtcatgaatggaactccaccagccacaaaaagacctgcctatacctggagtatcgtgcagtcagagtgctccgtctcctgtggtggaggtagatgattttctcattctgtctccaaagtctgtctctcttaaaacaggttctttcactccaggcgtctttaacataatatggtttaaataagccacccaagaactgtcttttatgagaaccatcaccataaaagcaaatattatggcattagttaagggttttcctatgtggtaaggaatcaactctcacaaagctcaaatcaaccacaaccaaggctcaaa

SEQ ID NO: 431 - DNA, 1632 bp, Homo sapiens
  ENST00000449265
agacgctcacaccgacacagacagacgcacagacgggcgggcagacaccgacagtctcccaaccgtttgcgctccagtcccggcccagggagccccccgtaccctctggggtgccgcaaactgcagctcggcaggcccgcgccgggagaagggagggcgcgcaggcggccggaggaggggaggtcccagcgcgcccccgctgcgatgtgaacggcggcggctctcacctggagccgcacctggggcgccgagctccggggccgcggaaagaatgcgcgccgcccgtgcgctccgcctgccgcgtctggccacccgcagccgccgcgtccgcacctgaccatggagtgcgccctcctgctcgcgtgtgccttcccggctgcgggttcgggcccgccgaggggcctggcgggactggggcgcgtggccaaggcgctccagctgtgctgcctctgctgtgcgtcggtcgccgcggccttagccagtgacagcagcagcggcgccagcggattaaatgatgattacgtctttgtcacgccagtagaagtagactcagccgggtcatatatttcacacgacattttgcacaacggcaggaaaaagcgatcggcgcagaatgccagaagctccctgcactaccgattttcagcatttggacaggaactgcacttagaacttaagccctcggcgattttgagcagtcactttattgtccaggtacttggaaaagatggtgcttcagagactcagaaacccgaggtgcagcaatgcttctatcagggatttatcagaaatgacagctcctcctctgtcgctgtgtctacgtgtgctggcttgtcaggtttaataaggacacgaaaaaatgaattcctcatctcgccattacctcagcttctggcccaggaacacaactacagctcccctgcgggtcaccatcctcacgtactgtacaaaaggacagcagaggagaagatccagcggtaccgtggctaccccggctctggccggaattatcctggttactccccaagtcacattccccatgcatctcagagtcgagagacagagtatcaccatcgaaggttgcaaaagcagcatttttgtggacgacgcaagaaatgtatatgctcccaagcctcccacagaggacacctatctaaggtttgatgaatatgggagctctgggcgacccagaagatcagctggaaaatcacaaaagggcctcaatgtggaaaccctcgtggtggcagacaagaaaatggtggaaaagcatggcaagggaaatgtcaccacatacattctcacagtaatgaacatggtttctggcctatttaaagatgggactattggaagtgacataaacgtggttgtggtgagcctaattcttctggaacaagaacctggtttgcccccatcagtggaatgtgctctaagtaccgaagttgtaccatcaatgaggacacaggacttggccttgccttcaccatcgctcatgagtcagggcacaactttggtatgattcacgatggagaagggaatccctgcagaaaggctgaaggcaatatcatgtctcccacactgaccggaaacaatggagtgttttcatggtcttcctgcagccgccagtatctcaag

SEQ ID NO: 432 - DNA, 556 bp, Homo sapiens
  ENST00000562345
aagtagactcagccgggtcatatatttcacacgacattttgcacaacggcaggaaaaagcgatcggcgcagaatgccagaagctccctgcactaccgattttcagcatttggacaggaactgcacttagaacttaagccctcggcgattttgagcagtcactttattgtccaggtacttggaaaagatggtgcttcagagactcagaaacccgaggtgcagcaatgcttctatcagggatttatcagaaatgacagctcctcctctgtcgctgtgtctacgtgtgctggcttgcttctggcccaggaacacaactacagctcccctgcgggtcaccatcctcacgtactgtacaaaaggacagcagaggagaagatccagcggtaccgtggctaccccggctctggccggaattatcctggttactccccaagtcacattccccatgcatctcagagtcgagagacagagtatcaccatcgaaggttgcaaaagcagcatttttgtggacgacgcaagaaatgtatatgctcccaagcctcccacagaggacacct

SEQ ID NO: 433 - DNA, 626 bp, Homo sapiens
  ENST00000567914
agctgaacttttcccattgcagattacgtctttgtcacgccagtagaagtagactcagccgggtcatatatttcacacgacattttgcacaacggcaggaaaaagcgatcggcgcagaatgccagaagctccctgcactaccgattttcagcatttggacaggaactgcacttagaacttaagccctcggcgattttgagcagtcactttattgtccaggtacttggaaaagatggtgcttcagagactcagaaacccgaggtgcagcaatgcttctatcagggatttatcagaaatgacagctcctcctctgtcgctgtgtctacgtgtgctggcttgtcaggtttaataaggacacgaaaaaatgaattcctcatctcgccattacctcagcttctggcccaggaacacaactacagctcccctgcgggtcaccatcctcacgtactgtacaaaaggacagcagaggagaagatccagcggtaccgtggctaccccggctctggccggaattatcctggttactccccaagtcacattccccatgcatctcagagtcgagagacagagtatcaccatcgaaggttgcaaaagcagcatttttgtggacgacgcaagaaatgtat

SEQ ID NO: 434 - DNA, 593 bp, Homo sapiens
  ENST00000567121
agcaattagtactgctctagggagcagtggtgaagattacgtctttgtcacgccagtagaagtagactcagccgggtcatatatttcacacgacattttgcacaacggcaggaaaaagcgatcggcgcagaatgccagaagctccctgcactaccgattttcagcatttggacaggaactgcacttagaacttaagccctcggcgattttgagcagtcactttattgtccaggtacttggaaaagatggtgcttcagagactcagaaacccgaggtgcagcaatgcttctatcagggatttatcagaaatgacagctcctcctctgtcgctgtgtctacgtgtgctggcttgtcaggtttaataaggacacgaaaaaatgaattcctcatctcgccattacctcagcttctggcccaggaacacaactacagctcccctgcgggtcaccatcctcacgtactgtacaaaaggacagcagaggagaagatccagcggtaccgtggctaccccggctctggccggaattatcctggttactccccaagtcacattccccatgcatctcagagtcgagagacagagtatcaccatc

SEQ ID NO: 435 - DNA, 574 bp, Homo sapiens
  ENST00000564369
accttttctcttgcaggcgctccagctgtgctgcctctgctgtgcgtcggtcgccgcggccttagccagtgacagcagcagcggcgccagcggattaaatgatgattacgtctttgtcacgccagtagaagtagactcagccgggtcatatatttcacacgacattttgcacaacggcaggaaaaagcgatcggcgcagaatgccagaagctccctgcactaccgattttcagcatttggacaggaactgcacttagaacttaagccctcggcgattttgagcagtcactttattgtccaggtacttggaaaagatggtgcttcagagactcagaaacccgaggtgcagcaatgcttctatcagggatttatcagaaatgacagctcctcctctgtcgctgtgtctacgtgtgctggcttgtcaggtttaataaggacacgaaaaaatgaattcctcatctcgccattacctcagcttctggcccaggaacacaactacagctcccctgcgggtcaccatcctcacgtactgtacaaaaggacagcagaggagaagatccagcggtaccgtggc

SEQ ID NO: 436 - DNA, 660 bp, Homo sapiens
  ENST00000569309
atatttgatctaggtgcaaggcaataggaacaaagatatctttgagctttgtgttgctctttgccagcttgctggaaagagaccatttggaattgtgggctctgggtgctgacagctgaacttttcccattgcagattacgtctttgtcacgccagtagaagtagactcagccgggtcatatatttcacacgacattttgcacaacggcaggaaaaagcgatcggcgcagaatgccagaagctccctgcactaccgattttcagcatttggacaggaactgcacttagaacttaagccctcggcgattttgagcagtcactttattgtccaggtacttggaaaagatggtgcttcagagactcagaaacccgaggtgcagcaatgcttctatcagggatttatcagaaatgacagctcctcctctgtcgctgtgtctacgtgtgctggcttggtcttcaaaccttgcttagttctttcattgtttttctcaataaactgaaagaatatttatgctacttcccagaatttcaagtccaactgaaggggaaagtttaataaggacacgaaaaaatgaattcctcatctcgccattacctcagcttctggcccaggaacacaactacagctcccctgcgggtcaccatcctcacgtactgtac

SEQ ID NO: 437 - DNA, 6754 bp, Homo sapiens
  ENST00000251582
agctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggggcctccctggacagcctggacagcctcagccgcgccctgggcgtcctagaggagcacgccaacagctcgaggcggagggcacgcaggcatgctgcggacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacacccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatgccaaggagagatgccacctgtactgcgagtccagggagaccggggaggtggtgtccatgaagcgcatggtgcatgacgggacgcgctgctcctacaaggacgccttcagcctctgtgtgcgcggggactgcaggaaggtgggctgtgacggtgtgatcggctccagcaagcaggaagacaagtgtggcgtgtgcggaggggacaacagccactgcaaagtggtcaagggcacgttcacacggtcacccaagaagcatggttacatcaagatgtttgagatccctgcaggagccagacacctgctcattcaggaggtagacgccaccagccaccatctggccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtcatcccggtgggagacacccgggtctcactgacgtacaaatacatgatccatgaggactcactgaatgtcgacgacaacaacgtcctggaagaggactctgtggtctacgagtgggccctgaagaagtggtctccgtgctccaagccctgtggcggagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccagtgctcagtaacctgtggcaacggcacccaggagcggccagtgctctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaataaaatggaaagatagcatccctagcatttttttcttgcttatagagatattccatgggatagcaaatcctgtgtcatggagatgaagtcaaaattcctgattccaaaaggttttgagaaaacaaagagggggaatgacgtaagaaagataggcatgagcatgtggtaactaggttagcacgtgtgcttcccagcccaggagcgaccaaatactgtggtggcgtcaggtgtgcagtggagaggaatatagaggctgtatggcctccctcagtgagggcagggcaagagggatcactctgagagaacaaaaataggccccaagttgctaagcagtgattgggaaccttcctttccttggcggagatgcatgacattccctaccgatccccagacacagcctgtgggactcttaggagaaatggtgatttactgaataactgacccgttgccgagatgagtacaatgaagtggaggtgatgaactcaaatcgtcttccagggccaggcggctgaccggggtgagcgtagtggcccgctggggaccatggccgccctgacagccacacccacctggagctgacttggttctggctgttgctgccactgtgaaatctgtatctctctccatctctgctctactatccccggccttgccagacagtgttctttttcggaagaagtctagatttttgcatgaaaaaaactcaatctttaaaggtcgactcagaacattttaaggaggcctccacttggtctgatgcagtcttgctaattaagaactaaaggccttctgaccttcttggtgctcatgctgtacggcatctgaatgtctcgaccgagtctgagccgtgcagctgtcctccacctgcgaaagtaatgagaatcctatcacgggacataaggataggtctaaacagggtccatgccaagaaaacagtggggtgctctcccaggcctctcccctgtccactaaccctggccttgccggctgccttccaggctctgggggaagagctcctgcattcttccctggccaccttggctccagggctccccagagagcctcttccctccccaagtacctgagaaagatgagagaggcacgtgctctgctgggaaggtccagtgagcggttcaagggcctggaatctccctacggccaagtctaagggttctgggattctgggctttgtgggctttgcttgcttgctgggaatgggctttccctgtcccgccctgccccacctcgcctctgtctctcagaagctccagaacccagcagtgacctgcaaaatgtggcctctgatgggggcttagggtgggagatggggagagcctacattgtcttttgctccttgaaaactttaatagctcctattttccagagaatggtgctttgtgagcaacatgcgagtaagagagaaataggaggaagggggagtaggggcggatgggagaagagtggctcatttttacctctcactgccttgacattttgtgaacgtgaagcttaaactttctgggcttacaagacccaggggcacgtcagctccttagatgggctcagcctgacacataattcttaaacctttcctgtttaagaaacttctagaggctgtgtactctcaccaatcctcttcgagaatttgttcatgtgtatttccccattatatggatgaggctcaggataacagcatagtggctaccttctactgagttttgaggtgctaataagtatgtttgtctgaggctgcacatgtgggtggctctgtgtgtatgatccaagggacaaaatgacgatgtaggaaccagcaagaacggaatctgggctgatgcttcagtctccacctgggtgatggctagcctcccgccctccaccaccgcatcccacacgtgctgcgcactgtccccgtgtctcctggagaaccaaactggagaaaacctttctgagtatctctcatagtaccccttccttaagaagatgtggtttagagcatgtgtgcaatcctgcctctgtaattaggaaacggagcccgaggctttccattgttggttgaacccaggacagctggtgctattcacaggctgaagaactgggcagttcttacttgggtctgtcctaggatgtggaggaagttcaggactaacgctaggcagagagtatgactcggtttacccagcctaggggcctctggatgggaacactccattccaagatctcagcagagcagggcttcctggcttgaggctggaagcctttgggaagaggcccagctgggacattccctgggcacctgtcttccgctgaagggagcaaggtgccctctgggactgacagccatgaccctctgtgccatcctcaatccttgagccatatatcaagagtcctctagagccggatggtcctcaaaagtctgtccaaggaatgccaacgttcaccgggctctgagaaacgacgcaaatctctgagctggggaccacttggagaaccggcttagtaacagtcctgatcttcgcaagccagcttcttctgcatctgaggggctcctggcgcccagaggaggcagacagatgtcttctagctgagtttctaaccgcatgatgagactcagaccttccgctgcactagaaaatctgcaacagtgtccctgagtcacttctccttagtgggcagactcgtgttagatttgtggaacccagctctctgatttactccttttggaaaacccatggaatttcatgtataaggctttcatttgtattttaaggtttttctgtttgttttgagtatatacatggtgctcaatagcaacatcttagcagatgaagcagtttatgattccactccctcctgtatgacaggtagccactatactgaatcaaggtgctgaactcaaatcacaaaattctggcttaccgatacaacaaccaatacatctttgttctgtaatgtaaaatttgactccttacttttataacttattaaagttaaaatgtctgtgtttttgcaaatcatg

SEQ ID NO: 438 - DNA, 455 bp, Homo sapiens
  ENST00000522937
gaatgacgcttccccaggaccccgggagacccggagcctctctgcctggggtgggggccccagcctggtgccctgcggccgcagcccctctctcctccctctaggaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcct

SEQ ID NO: 439 - DNA, 322 bp, Homo sapiens
  ENST00000523450
ctccagctctgccagtgcgggccctgtgtgggaggtgaaccctgcctggcgactctccccctgcagtgctcagtaacctgtggcaacggcacccaggagcggccagtgctctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgta

SEQ ID NO: 440 - DNA, 1703 bp, Homo sapiens
  ENST00000518335
gtaacctgtggcaacggcacccaggagcggccagtgctctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaagtaaccgacccgtttataactctgcctctgccctccagtgcatgccctgcgccctgtggagcttgccttgggcccccctcctctctgtctatggaaagctcccctgactctgcgggcgcgctctggggtgaccgttttctcccgggcctctgagctcggcgtccgctccgggccgcgctgcctgctggcgggggctcgggcctctgctggggccgaacctggttggtgatggcttgtaaaggggcaaagatctgtcgtggttgcaggaggggccggtggccaaagggcgaccctccgggccgagcccgtcccggcccgggggggttcgcggtctcgcggcgtcgtgcggggaccccaccccgagtttccggcactgccaggtgcttcccggctgccaccgccgtcgctgctgccgccgaccctttgctgagcgtgtccttctgactcgtggaactatggcccgcttccgcccggccttcgcgcagctcacagccccgcgcggccctgtcctgcgggggtccggtcgcggaggcggcggaggggcgcggggacactccccacctccactgtccgcccgtcggccccggtggccttttctcgcctcgcgcacagctcccccgccgcagggctgagagagagagtggccgtctggtgcgcgcgtgcctcgcccacgcgtgtgaaccactacagaattacctcaatttttattgcttttttgcttagaaaaactatgtagaagatgccttaaagttgaaaggtaacgggattggctgccaactccagcttcagagggggaacgtgggccagtagaaggcagggaaggtgtaggggagccggtgcgttcatccaccttttgccaaggttgaggtttccaagtgcagacggcttctctccttgggctgagcggtgcgcaccgtccgtctccgcggactggagtctgccctgatgccccactggccagtcggcgctgactgttgcatggagcccccgagggtgctccacagcgcggccttacacccagggggcgaccccctgggccctgagccgcgatccatgtagcactcctccccgcccctccaccccagccaccgcctctgttcacaccgcacccctgccgggcggccggcccctactcccgcggctctgaccgccgttctgtaaataactggtgtgcacctgcgtactaatctcacgactgttaacttccaactttgacgaggccatgcgagcgacacgcgcgactggggaaggtgcaatactgtcctgggcatatgcactttggtttatcagggatattttattagtgttttgtatgtatttaatgacgtattctataggttccattgtcgttgcttttctggttttttttatgagacgttagcgtgtgccaaagtgactgtgaaaatgacctttcattcttactaatgatggaaagacctcctgtcatgcatcccacaaataaactcaataaaagttccatgaaactggg

SEQ ID NO: 441 - DNA, 2044 bp, Homo sapiens
  ENST00000274609
agctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggggcctccctggacagcctggacagcctcagccgcgccctgggcgtcctagaggagcacgccaacagctcgaggcggagggcacgcaggcatgctgcggacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagttcaggccgggcgcggtggctcatgcctgttatcccagcactttgggaggccaaggtaggtggatcgcctgaggtcagaagttcaagacaagtctggttaacatggcaaaatcccgtctctactaaaaatacaaaaattagctgggcgcggtggtgggtgcctgtaatcccagctactccggaggctgaggcatgaaaatcgtttgagcccaggaggcggaggttgcggtgagccaagatcgcgtcgctgctctccagtctggatcacacagcaagaccctgtctcaaaaaataaaaataaaagtgaagtgca

SEQ ID NO: 442 - DNA, 6754 bp, Homo sapiens; identical to SEQ ID NO: 437
  ENST00000639986

SEQ ID NO: 443 - DNA, 455 bp, Homo sapiens; identical to SEQ ID NO: 438
  ENST00000639510

SEQ ID NO: 444 - DNA, 322 bp, Homo sapiens; identical to SEQ ID NO: 439
  ENST00000639035

SEQ ID NO: 445 - DNA, 1703 bp, Homo sapiens; identical to SEQ ID NO: 440
  ENST00000638226

SEQ ID NO: 446 - DNA, 2044 bp, Homo sapiens; identical to SEQ ID NO: 441
  ENST00000639107

SEQ ID NO: 447 - DNA, 7311 bp, Homo sapiens
  ENST00000381055
agtgtgctctgcctccgaggaaaagctgccaaaattttctcctgctgcaattcaagttggctgggggccggtagtgagatctagggctacttcaacaaaactttgctgcccttcctgctcctcttgtcttcttttctcctgataccttttgatgctctgcacatgttatttgcatagcaaaggcactaagctttccaggaagagagggcaccacttccacccccaataagtcttttttcccgtcttttctttcttttcctttccttttttggggggtggggagggagagaaagggggtttgcaaaggcagcatctcagagtgatagcctagatgtattgaaggcatctcttattctgccaaatcggaaagtcagttctctaaagcccgggttagccagaccatagggttttattctggctgcagaataactggctggtgtggctttgcaaaggggggcaaaaaataaaaaaataaaaaaaattaaaaaaagttagagaggagagggagtacgtgagtcgtccagtgcaatctctattgtctgaaacttactttttatcagaatttgaagatgaaaacggttaaaaaatggccatactttagtaactaatcagcctaatgctttgcttatgaaaacttttaccatcattatttttttcattttggattgagaaaatgaatccagatatagaagaaagtgcaggatgttggataaaagtggctcttaaacagtggaacatccaataactaatttgcaagaagttttaaagaaataaaattgttatgcttcgattttggtatggtattgactctttagcacataggtagccctcaaaaaaatcatccagttttctaaattatggaaattttgtggaagacgttgacctggattttgagcctcatcatggcttcatcggaatttcatagtgaccacaggctttcatacagttctcaagaggaattcctgacttatcttgaacactaccagctaactattccaataagggttgatcaaaatggagcatttctcagctttactgtgaaaaatgataaacactcaaggagaagacggagtatggaccctattgatccacagcaggcagtatctaagttattttttaaactttcagcctatggcaagcactttcatctaaacttgactctcaacacagattttgtgtccaaacattttacagtagaatattgggggaaagatggaccccagtggaaacatgattttttagacaactgtcattacacaggatatttgcaagatcaacgtagtacaactaaagtggctttaagcaactgtgttgggttgcatggtgttattgctacagaagatgaagagtattttatcgaacctttaaagaataccacagaggattccaagcattttagttatgaaaatggccaccctcatgttatttacaaaaagtctgcccttcaacaacgacatctgtatgatcactctcattgtggggtttcggatttcacaagaagtggcaaaccttggtggctgaatgacacatccactgtttcttattcactaccaattaacaacacacatatccaccacagacagaagagatcagtgagcattgaacggtttgtggagacattggtagtggcagacaaaatgatggtgggctaccatggccgcaaagacattgaacattacattttgagtgtgatgaatattgttgccaaactttaccgtgattccagcctaggaaacgttgtgaatattatagtggcccgcttaattgttctcacagaagatcagccaaacttggagataaaccaccatgcagacaagtccctcgatagcttctgtaaatggcagaaatccattctctcccaccaaagtgatggaaacaccattccagaaaatgggattgcccaccacgataatgcagttcttattactagatatgatatctgcacttataaaaataagccctgtggaacactgggcttggcctctgtggctggaatgtgtgagcctgaaaggagctgcagcattaatgaagacattggcctgggttcagcttttaccattgcacatgagattggtcacaattttggtatgaaccatgatggaattggaaattcttgtgggacgaaaggtcatgaagcagcaaaacttatggcagctcacattactgcgaataccaatcctttttcctggtctgcttgcagtcgagactacatcaccagctttctagattcaggccgtggtacttgccttgataatgagcctcccaagcgtgactttctttatccagctgtggccccaggtcaggtgtatgatgctgatgagcaatgtcgtttccagtatggagcaacctcccgccaatgtaaatatggggaagtgtgtagagagctctggtgtctcagcaaaagcaaccgctgtgtcaccaacagtattccagcagctgaggggacactgtgtcaaactgggaatattgaaaaagggtggtgttatcagggagattgtgttccttttggcacttggccccagagcatagatgggggctggggtccctggtcactatggggagagtgcagcaggacctgcgggggaggcgtctcctcatccctaagacactgtgacagtccagcaccttcaggaggtggaaaatattgccttggggaaaggaaacggtatcgctcctgtaacacagatccatgccctttgggttcccgagattttcgagagaaacagtgtgcagactttgacaatatgcctttccgaggaaagtattataactggaaaccctatactggaggtggggtaaaaccttgtgcattaaactgcttggctgaaggttataatttctacactgaacgtgctcctgcggtgatcgatgggacccagtgcaatgcggattcactggatatctgcatcaatggagaatgcaagcacgtaggctgtgataatattttgggatctgatgctagggaagatagatgtcgagtctgtggaggggacggaagcacatgtgatgccattgaagggttcttcaatgattcactgcccaggggaggctacatggaagtggtgcagataccaagaggctctgttcacattgaagttagagaagttgccatgtcaaagaactatattgctttaaaatctgaaggagatgattactatattaatggtgcctggactattgactggcctaggaaatttgatgttgctgggacagcttttcattacaagagaccaactgatgaaccagaatccttggaagctctaggtcctacctcagaaaatctcatcgtcatggttctgcttcaagaacagaatttgggaattaggtataagttcaatgttcccatcactcgaactggcagtggagataatgaagttggctttacatggaatcatcagccttggtcagaatgctcagctacttgtgctggaggtgtccaaagacaggaggtggtctgtaaaaggttggatgacaactccattgtccagaacaattactgtgatcctgacagtaagccacctgaaaatcaaagagcctgcaacactgagccctgcccacctgagtggttcattggggattggttggaatgcagcaagacttgtgatggtgggatgcgcacaagggcagtgctctgcatcaggaagatcggaccttctgaggaggagacgctggactacagtggttgtttaacacaccggcctgtcgaaaaagagccctgcaacaaccagtcatgtccaccacagtgggtggctttggactggtctgagtgtactccaaaatgtggtccaggattcaagcatcggattgttctgtgcaagagcagtgacctttctaagacattcccagctgcacaatgtccagaggaaagcaaacctcctgtccgcatccgctgcagtttgggccgctgccctcctcctcgctgggtcacaggagactggggccagtgttctgctcagtgtggccttggacagcagatgagaactgtgcagtgtctctcctacaccggacaggcatctagtgactgtctagaaactgttcggcctccatcaatgcagcagtgtgaaagcaaatgtgacagtacccccatttctaatactgaagagtgcaaagatgtgaataaagtggcttattgcccactggtgctgaagttcaagttctgcagtcgagcatacttcagacagatgtgttgtaagacctgccaaggacactgacccacagaaagccagagagagtgccttgtcatttcatcatggaaatgcatccatcaaagagagccacccagaggaagaggattgatgtccttgcaaatgcattaccctgtggaaaacgtaaccactggtcagccctagctgacaaaatttcaatattattttagcttctgtgaagtgggatttattgatccaaagtgctggacacggtattaggagggaatgccagattggagagatccaaacaacacagggagacttgcttactgtggagcgtttgtgttctttcgagtaaatccaatagcctgtttacctccttggaccattaagataatttttattatggacttagcaatgacactgaatccatttgtatttaaaactgtttaaaatgtagctgttatgacttggtcaactatggaagtgaagaaggttcagaattcttaagtcatagcttaaaaatatttactgtactttatctcactacaacagcaccacaatttaaattataaaacgggctttgaactataatttaaggagcaattataaatcaaaagtaatgaaagtttgtattatttttcttcattccacttaatttccttaggaataatcccctggttctgaacactgctgtgagccatatataaaactatattaaactgaacaataatgaggggcatagtttaaagcagtgcatcagttactgcagctgtgcaagtctataaactcagtgctgaaagactgtggccaacttgccattgtgcaagtaaagctgagatttccattaaaactttaagagaaaaacatttcaatttcatgcagaaaccagacctggggtatggtacagaccaaaggaccaggccctttgctgccaccacacaggatgccttagttcttatttgagtccctccaactcacttgtgtttacatcctccccagccacagcacggcttctgccctttggattgctgcacgtgtgttgagcttactgagatgataccatgcaaaagatagactggctcggtaaccaggcagacccttttgcagtttgttgacaattacgatgagttccagatgtcccttctttgatatggtagaagggcatttatttatatgagagcaaatgtgtgtgtgtgtttgcgggcgcttttaagtgtgtggatagatgagtgtgcttgcacataatgtgctatttctgtgagttttaaagtaggcaagggataataaccaaagaagaaaatttcatgaagactagacatcataaagcataattttaatagtcactcaaccaagtattttttattttttatggatactctgaatggcaattaaatgtgaaacccagtttcttgggcaagtcaaattctggaatcacatccacctaaattaaaatgactagctcgtattttccccatcttcaagtttcacatcctggtcatcaaaagactcgacagcaagacttagaatgaaaaagggtacttgtttatattaatattttttacttgaacacgtgtagcttgcagcaggttcttgatgaatgtgctttgtgtccaaaatgcctccccattgtacacaggtgtacaccatgcatgcaccaacacctaaaactcaaaactaaatggctattttgtaaggttaatactttcagttaaacagcatgtttgacttgattccatcatggtgctcttaaattacatgtcagtgcatcacatatatcatgatctaatgcagatgactaggctttttccaaaaggaagacagaccctcagacaccaaaagccaatctaaacaactcccaggtttgctgtggacaatcagcatggaatgttttctgcactctcagtcatgaccatctgtatcttgttacctgctttctctctcaacaccacagttctcaaccctgagccttccagagagagctattgatgatacaagaggaatcaccagggcccggatctaagatgcccttagaagaccagcccaagtgccgtcttagccattcagtgaagggcaaacagcccatgggtagtatggcccgagcactgaattcccttgcgccttttcaaagaacagttaacttggtgctaatgtgccctggtgaaataaataaaagatgggcagtttctgtggcattttaggcataggtttgcaatccagatctgattttctccaacataaatatcagctcatgttcttatttcaaaaagatttcttattaccgactaaaagctattttttacctcacctggaaactaccattgtgagggccatcccccaggcactgcacagcaccttggctgatgctggaagaggagggcagtcagtgtcacttctgggatgtgccccagcactgagaacaaaatgcaggcatcccccggggcagcatcagagtgcctttctagagggagccacgcacagaatgtaacaggatgaaacagtttcaagtaagccttgaattgaaacctgagtaggttaaaacaattctatttcatagcacatcacaatactgctgctactctgtagccacccccatggctacatgatgccctattcctaaataataacaatagcattgtcagtggaggctgggccaccatggcagaccttccaaaagtagtgagctacatagactacttagggaaccccagggaaactggtaccctacacctgggagcagtatctgccactgggataaagtcctactaaaaaaggaacggtaaatgtaccctaatgattaaaccccgtgagatacatatgatttccaaatagtccatttcattaggaacttttttgtttgaatgaatgtcacataggtatcctcagtaacacagaacgaaattacctttgtattattgtgattagttgttgcttattattttatactcagtaataatgtggtacactgttaatttttttgcttttgtaaattatattctaatttattgccatgtttcctaacacttgtcctacattcattctcctgcttgtaatgaaaatgaaaaaatcattgtaacacttgatggagtgaaattccacgccaggcacagaatttttttgacatagataatttagtaaaataaaaattcagcttataataatgata

SEQ ID NO: 448 - DNA, 6956 bp, Homo sapiens
  ENST00000381052
gggagtacgtgagtcgtccagtgcaatctctattgtctgaaacttactttttatcagaatttgaagatgaaaacggttaaaaaatggccatactttagtaactaatcagcctaatgctttgcttatgaaaacttttaccatcattatttttttcattttggattgagaaaatgaatccagatatagaagaaagtgcaggatgttggataaaagtggctcttaaacagtggaacatccaataactaatttgcaagaagttttaaagaaataaaattgttatgcttcgattttggtatggtattgactctttagcacataggtagccctcaaaaaaatcatccagttttctaaattatggaaattttgtggaagacgttgacctggattttgagcctcatcatggcttcatcggaatttcatagtgaccacaggctttcatacagttctcaagaggaattcctgacttatcttgaacactaccagctaactattccaataagggttgatcaaaatggagcatttctcagctttactgtgaaaaatgataaacactcaaggagaagacggagtatggaccctattgatccacagcaggcagtatctaagttattttttaaactttcagcctatggcaagcactttcatctaaacttgactctcaacacagattttgtgtccaaacattttacagtagaatattgggggaaagatggaccccagtggaaacatgattttttagacaactgtcattacacaggatatttgcaagatcaacgtagtacaactaaagtggctttaagcaactgtgttgggttgcatggtgttattgctacagaagatgaagagtattttatcgaacctttaaagaataccacagaggattccaagcattttagttatgaaaatggccaccctcatgttatttacaaaaagtctgcccttcaacaacgacatctgtatgatcactctcattgtggggtttcggatttcacaagaagtggcaaaccttggtggctgaatgacacatccactgtttcttattcactaccaattaacaacacacatatccaccacagacagaagagatcagtgagcattgaacggtttgtggagacattggtagtggcagacaaaatgatggtgggctaccatggccgcaaagacattgaacattacattttgagtgtgatgaatattgtcaggttgccaaactttaccgtgattccagcctaggaaacgttgtgaatattatagtggcccgcttaattgttctcacagaagatcagccaaacttggagataaaccaccatgcagacaagtccctcgatagcttctgtaaatggcagaaatccattctctcccaccaaagtgatggaaacaccattccagaaaatgggattgcccaccacgataatgcagttcttattactagatatgatatctgcacttataaaaataagccctgtggaacactgggcttggcctctgtggctggaatgtgtgagcctgaaaggagctgcagcattaatgaagacattggcctgggttcagcttttaccattgcacatgagattggtcacaattttggtatgaaccatgatggaattggaaattcttgtgggacgaaaggtcatgaagcagcaaaacttatggcagctcacattactgcgaataccaatcctttttcctggtctgcttgcagtcgagactacatcaccagctttctagaatttcttaaactcggtgattcaataagtggttcatgaatcgcccagaagccgtcctgattaaataataaagaacccatttccgttaaaatggacgtgttatgccagcttctgatgttttccggcgacggctttgcagttcaggccgtggtacttgccttgataatgagcctcccaagcgtgactttctttatccagctgtggccccaggtcaggtgtatgatgctgatgagcaatgtcgtttccagtatggagcaacctcccgccaatgtaaatatgggtgtgtagagagctctggtgtctcagcaaaagcaaccgctgtgtcaccaacagtattccagcagctgaggggacactgtgtcaaactgggaatattgaaaaagggtggtgttatcagggagattgtgttccttttggcacttggccccagagcatagatgggggctggggtccctggtcactatggggagagtgcagcaggacctgcgggggaggcgtctcctcatccctaagacactgtgacagtccagcgtaagtagctaaaaccttcaggaggtggaaaatattgccttggggaaaggaaacggtatcgctcctgtaacacagatccatgccctttgggttcccgagattttcgagagaaacagtgtgcagactttgacaatatgcctttccgaggaaagtattataactggaaaccctatactggaggtggggtaaaaccttgtgcattaaactgcttggctgaaggttataatttctacactgaacgtgctcctgcggtgatcgatgggacccagtgcaatgcggattcactggatatctgcatcaatggagaatgcaagcacgtaggctgtgataatattttgggatctgatgctagggaagatagatgtcgagtctgtggaggggacggaagcacatgtgatgccattgaagggttcttcaatgattcactgcccaggggaggctacatggaagtggtgcagataccaagaggctctgttcacattgaagttagagaagttgccatgtcaaagaactatattgctttaaaatctgaaggagatgattactatattaatggtgcctggactattgactggcctaggaaatttgatgttgctgggacagcttttcattacaagagaccaactgatgaaccagaatccttggaagctctaggtcctacctcagaaaatctcatcgtcatggttctgcttcaagaacagaatttgggaattaggtataagttcaatgttcccatcactcgaactggcagtggagataatgaagttggctttacatggaatcatcagccttggtcagaatgctcagctacttgtgctggaggtgtccaaagacaggaggtggtctgtaaaaggttggatgacaactccattgtccagaacaattactgtgatcctgacagtaagccacctgaaaatcaaagagcctgcaacactgagccctgcccacctgagtggttcattggggattggttggaatgcagcaagacttgtgatggtgggatgcgcacaagggcagtgctctgcatcaggaagatcggaccttctgaggaggagacgctggactacagtggttgtttaacacaccggcctgtcgaaaaagagccctgcaacaaccagtcatgtccaccacagtgggtggctttggactggtctgagtgtactccaaaatgtggtccaggattcaagcatcggattgttctgtgcaagagcagtgacctttctaagacattcccagctgcacaatgtccagaggaaagcaaacctcctgtccgcatccgctgcagtttgggccgctgccctcctcctcgctgggtcacaggagactggggccagtgttctgctcagtgtggccttggacagcagatgagaactgtgcagtgtctctcctacaccggacaggcatctagtgactgtctagaaactgttcggcctccatcaatgcagcagtgtgaaagcaaatgtgacagtacccccatttctaatactgaagagtgcaaagatgtgaataaagtggcttattgcccactggtgctgaagttcaagttctgcagtcgagcatacttcagacagatgtgttgtaagacctgccaaggacactgacccacagaaagccagagagagtgccttgtcatttcatcatggaaatgcatccatcaaagagagccacccagaggaagaggattgatgtccttgcaaatgcattaccctgtggaaaacgtaaccactggtcagccctagctgacaaaatttcaatattattttagcttctgtgaagtgggatttattgatccaaagtgctggacacggtattaggagggaatgccagattggagagatccaaacaacacagggagacttgcttactgtggagcgtttgtgttctttcgagtaaatccaatagcctgtttacctccttggaccattaagataatttttattatggacttagcaatgacactgaatccatttgtatttaaaactgtttaaaatgtagctgttatgacttggtcaactatggaagtgaagaaggttcagaattcttaagtcatagcttaaaaatatttactgtactttatctcactacaacagcaccacaatttaaattataaaacgggctttgaactataatttaaggagcaattataaatcaaaagtaatgaaagtttgtattatttttcttcattccacttaatttccttaggaataatcccctggttctgaacactgctgtgagccatatataaaactatattaaactgaacaataatgaggggcatagtttaaagcagtgcatcagttactgcagctgtgcaagtctataaactcagtgctgaaagactgtggccaacttgccattgtgcaagtaaagctgagatttccattaaaactttaagagaaaaacatttcaatttcatgcagaaaccagacctggggtatggtacagaccaaaggaccaggccctttgctgccaccacacaggatgccttagttcttatttgagtccctccaactcacttgtgtttacatcctccccagccacagcacggcttctgccctttggattgctgcacgtgtgttgagcttactgagatgataccatgcaaaagatagactggctcggtaaccaggcagacccttttgcagtttgttgacaattacgatgagttccagatgtcccttctttgatatggtagaagggcatttatttatatgagagcaaatgtgtgtgtgtgtttgcgggcgcttttaagtgtgtggatagatgagtgtgcttgcacataatgtgctatttctgtgagttttaaagtaggcaagggataataaccaaagaagaaaatttcatgaagactagacatcataaagcataattttaatagtcactcaaccaagtattttttattttttatggatactctgaatggcaattaaatgtgaaacccagtttcttgggcaagtcaaattctggaatcacatccacctaaattaaaatgactagctcgtattttccccatcttcaagtttcacatcctggtcatcaaaagactcgacagcaagacttagaatgaaaaagggtacttgtttatattaatattttttacttgaacacgtgtagcttgcagcaggttcttgatgaatgtgctttgtgtccaaaatgcctccccattgtacacaggtgtacaccatgcatgcaccaacacctaaaactcaaaactaaatggctattttgtaaggttaatactttcagttaaacagcatgtttgacttgattccatcatggtgctcttaaattacatgtcagtgcatcacatatatcatgatctaatgcagatgactaggctttttccaaaaggaagacagaccctcagacaccaaaagccaatctaaacaactcccaggtttgctgtggacaatcagcatggaatgttttctgcactctcagtcatgaccatctgtatcttgttacctgctttctctctcaacaccacagttctcaaccctgagccttccagagagagctattgatgatacaagaggaatcaccagggcccggatctaagatgcccttagaagaccagcccaagtgccgtcttagccattcagtgaagggcaaacagcccatgggtagtatggcccgagcactgaattcccttgcgccttttcaaagaacagttaacttggtgctaatgtgccctggtgaaataaataaaagatgggcagtttctgtggcattttaggcataggtttgcaatccagatctgattttctccaacataaatatcagctcatgttcttatttcaaaaagatttcttattaccgactaaaagctattttttacctcacctggaaactaccattgtgagggccatcccccaggcactgcacagcaccttggctgatgctggaagaggagggcagtcagtgtcacttctgggatgtgccccagcactgagaacaaaatgcaggcatcccccggggcagcatcagagtgcctttctagagggagccacgcacagaatgtaacaggatgaaacagtttcaagtaagccttgaattgaaacctgagtaggttaaaacaattctatttcatagcacatcacaatactgctgctactctgtagccacccccatggctacatgatgccctattcctaaataataacaatagcattgtcagtggaggctgggccaccatggcagaccttccaaaagtagtgagctacatagactacttagggaaccccagggaaactggtaccctacacctgggagcagtatctgccactgggataaagtcctactaaaaaaggaacggtaaatgtaccctaatgattaaaccccgtgagatacatatgatttccaaatagtccatttcattaggaacttttttgtttgaatgaatgtcacataggtatcctcagtaacacagaacgaaattacctttgtattattgtgattagttgttgcttattattttatactcagtaataatgtggtacactgttaatttttttgcttttgtaaattatattctaatttattgccatgtttcctaacacttgtcctacattcattctcctgcttgtaatgaaaatgaaaaaatcattgtaacacttgatggagtgaaattccacgccaggcacagaatttttttgacatagataatttagtaaaataaaaattcagcttataataatg

SEQ ID NO: 449 - DNA, 1322 bp, Homo sapiens
  ENST00000314351
atactctaggacattttgccagtaagttgtttgactatgtttaagacccctaagtttaggaaaacataaaaaatggttgcagaaggtgatcagcaagagccctgggtcagtgcaagcaataaaaaagactaactgctcaccactgtcatggaagctacaggatttaagtgtcatgagcttggtggatttaatagtttgccctgtcagtctttaaatttaaagggcttagttaaaggtgtccaaagacaggaggtggtctgtaaaaggttggatgacaactccattgtccagaacaattactgtgatcctgacagtaagccacctgaaaatcaaagagcctgcaacactgagccctgcccacctgagtggttcattggggattggttggaatgcagcaagacttgtgatggtgggatgcgcacaagggcagtgctctgcatcaggaagatcggaccttctgaggaggagacgctggactacagtggttgtttaacacaccggcctgtcgaaaaagagccctgcaacaaccagtcatgtccaccacagtgggtggctttggactggtctgagtgtactccaaaatgtggtccaggattcaagcatcggattgttctgtgcaagagcagtgacctttctaagacattcccagctgcacaatgtccagaggaaagcaaacctcctgtccgcatccgctgcagtttgggccgctgccctcctcctcgctgggtcacaggagactggggccagtgttctgctcagtgtggccttggacagcagatgagaactgtgcagtgtctctcctacaccggacaggcatctagtgactgtctagaaactgttcggcctccatcaatgcagcagtgtgaaagcaaatgtgacagtacccccatttctaatactgaagagtgcaaagatgtgaataaagtggcttattgcccactggtgctgaagttcaagttctgcagtcgagcatacttcagacagatgtgttgtaagacctgccaaggacactgacccacagaaagccagagagagtgccttgtcatttcatcatggaaatgcatccatcaaagagagccacccagaggaagaggattgatgtccttgcaaatgcattaccctgtggaaaacgtaaccactggtcagccctagctgacaaaatttcaatattattttagcttctgtgaagtgggatttattgatccaaagtgctggacacggtattaggagggaatgccagattggagagatccaaacaacacagggagacttgcttactgtggagcgtttgtgttctttcgagtaaatccaatagcctgttt

SEQ ID NO: 450 - DNA, 550 bp, Homo sapiens
  ENST00000417396
ttttcatgggtgccttttccctacaatttactctattcctaatcctcctccctctagtggccaccaatgcaattctttacctctggctgggagagcaggacagttggcttccttcaaagccaacacccttgctgctgcatggactggtgtccaaagacaggaggtggtctgtaaaaggttggatgacaactccattgtccagaacaattactgtgatcctgacagtaagccacctgaaaatcaaagagcctgcaacactgagccctgcccacctgagtggttcattggggattggttggaatgcagcaagacttgtgatggtgggatgcgcacaagggcagtgctctgcatcaggaagatcggaccttctgaggaggagacgctggactacagtggttgtttaacacaccggcctgtcgaaaaagagccctgcaacaaccagtcatgtccaccacagtgggtggctttggactggtctgagtgtactccaaaatgtggtccaggattcaagcatcggattgttctgtgcaagagcagtgacctttctaag

SEQ ID NO: 451 - DNA, 2850 bp, Homo sapiens
  ENST00000470597
aatcatccagttttctaaattatggaaattttgtggaagacgttgacctggattttgagcctcatcatggcttcatcggaatttcatagtgaccacaggctttcatacagttctcaagaggaattcctgacttatcttgaacactaccagctaactattccaataagggttgatcaaaatggagcatttctcagctttactgtgaaaaatgataaacactcaaggagaagacggagtatggaccctattgatccacagcaggcagtatctaagttattttttaaactttcagcctatggcaagcactttcatctaaacttgactctcaacacagattttgtgtccaaacattttacagtagaatattgggggaaagatggaccccagtggaaacatgattttttagacaactgtcattacacaggatatttgcaagatcaacgtagtacaactaaagtggctttaagcaactgtgttgggttgcatggtgttattgctacagaagatgaagagtattttatcgaacctttaaagaataccacagaggattccaagcattttagttatgaaaatggccaccctcatgttatttacaaaaagtctgcccttcaacaacgacatctgtatgatcactctcattgtggggtttcggatttcacaagaagtggcaaaccttggtggctgaatgacacatccactgtttcttattcactaccaattaacaacacacatatccaccacagacagaagagatcagtgagcattgaacggtttgtggagacattggtagtggcagacaaaatgatggtgggctaccatggccgcaaagacattgaacattacattttgagtgtgatgaatattgttgccaaactttaccgtgattccagcctaggaaacgttgtgaatattatagtggcccgcttaattgttctcacagaagatcagccaaacttggagataaaccaccatgcagacaagtccctcgatagcttctgtaaatggcagaaatccattctctcccaccaaagtgatggaaacaccattccagaaaatgggattgcccaccacgataatgcagttcttattactagatatgatatctgcacttataaaaataagccctgtggaacactgggcttggcctctgtggctggaatgtgtgagcctgaaaggagctgcagcattaatgaagacattggcctgggttcagcttttaccattgcacatgagattggtcacaattttggtatgaaccatgatggaattggaaattcttgtgggacgaaaggtcatgaagcagcaaaacttatggcagctcacattactgcgaataccaatcctttttcctggtctgcttgcagtcgagactacatcaccagctttctagagaagtgtgtagagagctctggtgtctcagcaaaagcaaccgctgtgtcaccaacagtattccagcagctgaggggacactgtgtcaaactgggaatattgaaaaagggtggtgttatcagggagattgtgttccttttggcacttggccccagagcatagatgggggctggggtccctggtcactatggggagagtgcagcaggacctgcgggggaggcgtctcctcatccctaagacactgtgacagtccagcaccttcaggaggtggaaaatattgccttggggaaaggaaacggtatcgctcctgtaacacagatccatgccctttgggttcccgagattttcgagagaaacagtgtgcagactttgacaatatgcctttccgaggaaagtattataactggaaaccctatactggaggtggggtaaaaccttgtgcattaaactgcttggctgaaggttataatttctacactgaacgtgctcctgcggtgatcgatgggacccagtgcaatgcggattcactggatatctgcatcaatggagaatgcaagcacgtaggctgtgataatattttgggatctgatgctagggaagatagatgtcgagtctgtggaggggacggaagcacatgtgatgccattgaagggttcttcaatgattcactgcccaggggaggctacatggaagtggtgcagataccaagaggctctgttcacattgaagttagagaagttgccatgtcaaagaactatattgctttaaaatctgaaggagatgattactatattaatggtgcctggactattgactggcctaggaaatttgatgttgctgggacagcttttcattacaagagaccaactgatgaaccagaatccttggaagctctaggtcctacctcagaaaatctcatcgtcatggttctgcttcaagaacagaatttgggaattaggtataagttcaatgttcccatcactcgaactggcagtggagataatgaagttggctttacatggaatcatcagccttggtcagaatgctcagctacttgtgctggaggtaagatgcccactaggcagcccacccagagggcaagatggagaacaaaacacattctgagctatgctttgtgtttgttaaaaaagctaattggaaacatttcttgcaggtttgcttcaagctgtaatttagcaaaagaaactttgctttaattatattatattccatttgttttcaacctcatgtaatttgtgcagatttgttggtaaaatacatcttggcacaatgagtgtctctgctggtgcttctcccaagactatcttgaaggtgggctgtttgcctttcgtgaacacattcttggtaaagaacatcaaaagttttaaaaaagaaaatgagcaagaatcagacatcacagatgcaacttcttgtaatgggagatgagaatgtacggctgtg

SEQ ID NO: 452 - DNA, 2742 bp, Homo sapiens
  ENST00000464680
catccagttttctaaattatggaaattttgtggaagacgttgacctggattttgagcctcatcatggcttcatcggaatttcatagtgaccacaggctttcatacagttctcaagaggaattcctgacttatcttgaacactaccagctaactattccaataagggttgatcaaaatggagcatttctcagctttactgtgaaaaatgataaacactcaaggagaagacggagtatggaccctattgatccacagcaggcagtatctaagttattttttaaactttcagcctatggcaagcactttcatctaaacttgactctcaacacagattttgtgtccaaacattttacagtagaatattgggggaaagatggaccccagtggaaacatgattttttagacaactgtcattacacaggatatttgcaagatcaacgtagtacaactaaagtggctttaagcaactgtgttgggttgcatggtgttattgctacagaagatgaagagtattttatcgaacctttaaagaataccacagaggattccaagcattttagttatgaaaatggccaccctcatgttatttacaaaaagtctgcccttcaacaacgacatctgtatgatcactctcattgtggggtttcggatttcacaagaagtggcaaaccttggtggctgaatgacacatccactgtttcttattcactaccaattaacaacacacatatccaccacagacagaagagatcagtgagcattgaacggtttgtggagacattggtagtggcagacaaaatgatggtgggctaccatggccgcaaagacattgaacattacattttgagtgtgatgaatattgttgccaaactttaccgtgattccagcctaggaaacgttgtgaatattatagtggcccgcttaattgttctcacagaagatcagccaaacttggagataaaccaccatgcagacaagtccctcgatagcttctgtaaatggcagaaatccattctctcccaccaaagtgatggaaacaccattccagaaaatgggattgcccaccacgataatgcagttcttattactagatatgatatctgcacttataaaaataagccctgtggaacactgggcttggcctctgtggctggaatgtgtgagcctgaaaggagctgcagcattaatgaagacattggcctgggttcagcttttaccattgcacatgagattggtcacaattttggtatgaaccatgatggaattggaaattcttgtgggacgaaaggtcatgaagcagcaaaacttatggcagctcacattactgcgaataccaatcctttttcctggtctgcttgcagtcgagactacatcaccagctttctagattcaggccgtggtacttgccttgataatgagcctcccaagcgtgactttctttatccagctgtggccccaggtcaggtgtatgatgctgatgagcaatgtcgtttccagtatggagcaacctcccgccaatgtaaatatggggaagtgtgtagagagctctggtgtctcagcaaaagcaaccgctgtgtcaccaacagtattccagcagctgaggggacactgtgtcaaactgggaatattgaaaaagggtggtgttatcagggagattgtgttccttttggcacttggccccagagcatagatgggggctggggtccctggtcactatggggagagtgcagcaggacctgcgggggaggcgtctcctcatccctaagacactgtgacagtccagcaccttcaggaggtggaaaatattgccttggggaaaggaaacggtatcgctcctgtaacacagatccatgccctttgggttcccgagattttcgagagaaacagtgtgcagactttgacaatatgcctttccgaggaaagtattataactggaaaccctatactggaggtggggtaaaaccttgtgcattaaactgcttggctgaaggttataatttctacactgaacgtgctcctgcggtgatcgatgggacccagtgcaatgcggattcactggatatctgcatcaatggagaatgcaagcacgtaggctgtgataatattttgggatctgatgctagggaagatagatgtcgagtctgtggaggggacggaagcacatgtgatgccattgaagggttcttcaatgattcactgcccaggggaggctacatggaagtggtgcagataccaagaggctctgttcacattgaagttagagaagttgccatgtcaaagaactatattgctttaaaatctgaaggagatgattactatattaatggtgcctggactattgactggcctaggaaatttgatgttgctgggacagcttttcattacaagagaccaactgatgaaccagaatccttggaagctctaggtcctacctcagaaaatctcatcgtcatggttctgcttcaagaacagaatttgggaattaggtataagttcaatgttcccatcactcgaactggcagtggagataatgaagttggctttacatggaatcatcagccttggtcagaatgctcagctacttgtgctggaggtaagatgcccactaggcagcccacccagagggcaagatggagaacaaaacacattctgagctatgctttgtgtttgttaaaaaagctaattggaaacatttcttgcaggtttgcttcaagctgtaatttagcaaaagaaactttgctt

SEQ ID NO: 453 - DNA, 350 bp, Homo sapiens
  ENST00000504282
cttttggcacttggccccagagcatagatgggggctggggtccctggtcactatggggagagtgcagcaggacctgcgggggaggcgtctcctcatccctaagacactgtgacagtccagcaccttcaggaggtggaaaatattgccttggggaaaggaaacggtatcgctcctgtaacacagatcagattataaggagatacagttaacataactatattatggatacatatatatttatgttttcttcattaatattgactctactagctcagaacttgaggcaattctgctgtcatactaaaatgtattttcatgctatccaagttaataaagttgtctgaatgtaa

SEQ ID NO: 454 - DNA, 1237 bp, Homo sapiens
  ENST00000502886
atggaaattttgtggaagacgttgacctggattttgagcctcatcatggcttcatcggaatttcatagtgaccacaggctttcatacagttctcaagaggaattcctgacttatcttgaacactaccagctaactattccaataagggttgatcaaaatggagcatttctcagctttactgtgaaaaatgataaacactcaaggagaagacggagtatggaccctattgatccacagcaggcagtatctaagttattttttaaactttcagcctatggcaagcactttcatctaaacttgactctcaacacagattttgtgtccaaacattttacagtagaatattgggggaaagatggaccccagtggaaacatgattttttagacaactgtcattacacaggatatttgcaagatcaacgtagtacaactaaagtggctttaagcaactgtgttgggttgcatggtgttattgctacagaagatgaagagtattttatcgaacctttaaagaataccacagaggattccaagcattttagttatgaaaatggccaccctcatgttatttacaaaaagtctgcccttcaacaacgacatctgtatgatcactctcattgtggggtttcggatttcacaagaagtggcaaaccttggtggctgaatgacacatccactgtttcttattcactaccaattaacaacacacatatccaccacagacagaagagatcagtgagcattgaacggtttgtggagacattggtagtggcagacaaaatgatggtgggctaccatggccgcaaagacattgaacattacattttgagtgtgatgaatattgtcaggttgccaaactttaccgtgattccagcctaggaaacgttgtgaatattatagtggcccgcttaattgttctcacagaagatcagccaaacttggagataaaccaccatgcagacaagtccctcgatagcttctgtaaatggcagaaatccattctctcccaccaaagtgatggaaacaccattccagaaaatgggattgcccaccacgataatgcagttcttattactaggtatggtttgttgcaagtatttttccattgattgttgtgtttattcactattgtaataaatttggttctatgtaaagcctcattcagataatgagtatagagaaagcaaaatggtaatttatttttcactactgagaaagaatgtattacactattatt

SEQ ID NO: 455 - DNA, 5490 bp, Homo sapiens
  ENST00000388820
cttttctttgcctctgcagcggccaagggggcgggccctgcagcctttgttgcccgcggaccgagcgcagccgaacggagtcggggccgggtcgccgggagctgcacgccggccgggcatgtcctgagccggacctgggaccaggcagcgaccggacgggacggacgagagcgtgcgcgcggggtcacccggcggccgcccggttcctgccatgcccggcggccccagtccccgcagccccgcgcctttgctgcgccccctcctcctgctcctctgcgctctggctcccggcgcccccggacccgcaccaggacgtgcaaccgagggccgggcggcactggacatcgtgcacccggttcgagtcgacgcggggggctccttcctgtcctacgagctgtggccccgcgcactgcgcaagcgggatgtatctgtgcgccgagacgcgcccgccttctacgagctacaataccgcgggcgcgagctgcgcttcaacctgaccgccaatcagcacctgctggcgcccggctttgtgagcgagacgcggcggcgcggcggcctgggccgcgcgcacatccgggcccacaccccggcctgccacctgcttggcgaggtgcaggaccctgagctcgagggtggcctggcggccatcagcgcctgcgacggcctgaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtggctggcctgtttcatgaccccagcattgggaaccccatccacatcaccattgtgcgcctggtcctgctggaagatgaggaggaggacctaaagatcacgcaccatgcagacaacaccctgaagagcttctgcaagtggcagaaaagcatcaacatgaagggggatgcccatcccctgcaccatgacactgccatcctgctcaccagaaaggacctgtgtgcagccatgaaccggccctgtgagaccctgggactgtcccatgtggcgggcatgtgccagccgcaccgcagctgcagcatcaacgaggacacgggcctgccgctggccttcactgtagcccacgagctcgggcacagttttggcattcagcatgacggaagcggcaatgactgtgagcccgttgggaaacgacctttcatcatgtctccacagctcctgtacgacgccgctcccctcacctggtcccgctgcagccgccagtatatcaccaggttccttgaccgtgggtggggcctgtgcctggacgaccctcctgccaaggacattatcgacttcccctcggtgccacctggcgtcctctatgatgtaagccaccagtgccgcctccagtacggggcctactctgccttctgcgaggacatggataatgtctgccacacactctggtgctctgtggggaccacctgtcactccaagctggatgcagctgtggacggcacccggtgtggggagaataagtggtgtctcagtggggagtgcgtacccgtgggcttccggcccgaggccgtggatggtggctggtctggctggagcgcctggtccatctgctcacggagctgtggcatgggcgtacagagcgccgagcggcagtgcacgcagcctacgcccaaatacaaaggcagatactgtgtgggtgagcgcaagcgcttccgcctctgcaacctgcaggcctgccctgctggccgcccctccttccgccacgtccagtgcagccactttgacgctatgctctacaagggccagctgcacacatgggtgcccgtggtcaatgacgtgaacccctgcgagctgcactgccggcccgcgaatgagtactttgccgagaagctgcgggacgccgtggtcgatggcaccccctgctaccaggtccgagccagccgggacctctgcatcaacggcatctgtaagaacgtgggctgtgacttcgagattgactccggtgctatggaggaccgctgtggtgtgtgccacggcaacggctccacctgccacaccgtgagcgggaccttcgaggaggccgagggcctggggtatgtggatgtggggctgatcccagcgggcgcacgcgagatccgcatccaagaggttgccgaggctgccaacttcctggcactgcggagcgaggacccggagaagtacttcctcaatggtggctggaccatccagtggaacggggactaccaggtggcagggaccaccttcacatacgcacgcaggggcaactgggagaacctcacgtccccgggtcccaccaaggagcctgtctggatccagctgctgttccaggagagcaaccctggggtgcactacgagtacaccatccacagggaggcaggtggccacgacgaggtcccgccgcccgtgttctcctggcattatgggccctggaccaagtgcacagtcacctgcggcagaggtgtgcagaggcagaatgtgtactgcttggagcggcaggcagggcccgtggacgaggagcactgtgaccccctgggccggcctgatgaccaacagaggaagtgcagcgagcagccctgccctgccaggtggtgggcaggtgagtggcagctgtgctccagctcctgcgggcctgggggcctctcccgccgggccgtgctctgcatccgcagcgtggggctggatgagcagagcgccctggagccacccgcctgtgaacaccttccccggccccctactgaaaccccttgcaaccgccatgtaccctgtccggccacctgggctgtggggaactggtctcagtgctcagtgacatgtggggagggcactcagcgccgaaatgtcctctgcaccaatgacaccggtgtcccctgtgacgaggcccagcagccagccagcgaagtcacctgctctctgccactctgtcggtggcccctgggcacactgggccctgaaggctcaggcagcggctcctccagccacgagctcttcaacgaggctgacttcatcccgcaccacctggccccacgcccttcacccgcctcatcacccaagccaggcaccatgggcaacgccattgaggaggaggctccagagctggacctgccggggcccgtgtttgtggacgacttctactacgactacaatttcatcaatttccacgaggatctgtcctacgggccctctgaggagcccgatctagacctggcggggacaggggaccggacacccccaccacacagccatcctgctgcgccctccacgggtagccccgtgcctgccacagagcctcctgcagccaaggaggagggggtactgggaccttggtccccgagcccttggcctagccaggccggccgctccccacccccaccctcagagcagacccctgggaaccctttgatcaatttcctgcctgaggaagacacccccataggggccccagatcttgggctccccagcctgtcctggcccagggtttccactgatggcctgcagacacctgccacccctgagagccaaaatgatttcccagttggcaaggacagccagagccagctgccccctccatggcgggacaggaccaatgaggttttcaaggatgatgaggaacccaagggccgaggagcaccccacctgcccccgagacccagctccacgctgccccctttgtcccctgttggcagcacccactcctctcctagtcctgacgtggcggagctgtggacaggaggcacagtggcctgggagccagctctggagggtggcctggggcctgtggacagtgaactgtggcccactgttggggtggcttctctccttcctcctcccatagcccctctgccagagatgaaggtcagggacagttccctggagccggggactccctccttcccaaccccaggaccaggctcatgggacctgcagactgtggcagtgtgggggaccttcctccccacaaccctgactggcctcgggcacatgcctgagcctgccctgaacccaggacccaagggtcagcctgagtccctcagccctgaggtgcccctgagctctaggctgctgtccacaccagcttgggacagccccgccaacagccacagagtccctgagacccagccgctggctcccagcctggctgaagcggggccccccgcggacccgttggttgtcaggaacgccggctggcaagcgggaaactggagcgagtgctctaccacctgtggcctgggtgcggtctggaggccggtgcgctgtagctccggccgggatgaggactgcgcccccgctggccggccccagcctgcccgccgctgccacctgcggccctgtgccacctggcactcaggcaactggagtaagtgctcccgcagctgcggcggaggttcctcagtgcgggacgtgcagtgtgtggacacacgggacctccggccactgcggcccttccattgtcagcccgggcctgccaagccgcctgcgcaccggccctgcggggcccagccctgcctcagctggtacacatcttcctggagggagtgctccgaggcctgtggcggtggtgagcagcagcgtctagtgacctgcccggagccaggcctctgcgaggaggcgctgagacccaacaccacccggccctgcaacacccacccctgcacgcagtgggtggtggggccctggggccagtgctcaggcccctgtggtggtggtgtccagcggcgcctggtcaagtgtgtcaacacccagacagggctgcccgaggaagacagtgaccagtgtggccacgaggcctggcctgagagctcccggccgtgtggcaccgaggattgtgagcccgtcgagcctccccgctgtgagcgggaccgcctgtccttcgggttctgcgagacgctgcgcctactgggccgctgccagctgcccaccatccgcacccagtgctgccgctcgtgctctccgcccagccacggcgccccctcccgaggccatcagcgggttgcccgccgctgactgcgccaggatgcacagaccgaccgacagacctcagtgcccaccacgggctgtggcggagctcccgccccctgcgccctaatggtgctaaccccctctcactacccagcagcaggctggggacctcctccccctcaaaaaaggtatttttttattctaacagtttgtgtaacatttattatgattttacataaatgagcatctaccattccaaagca

SEQ ID NO: 456 - DNA, 708 bp, Homo sapiens
  ENST00000569934
gcccacagggcttgttttgcgcagggatacccagcgatttggctgctggtaccaggacccagccttccttccctggtgcctctgggaagcgacgaggctggtcaagatagctggtcggggtgcccacagggtcccctccccccacctctgcaccaatgacactggaacacaggccctttgtcccatgtgagcagggacggctggttgctgaggggatttgacttttcattctcacggtcttcctgggaggtgggtgaaggagcctattttgcaaataaggaaactgaggcccagaagagggcccctgtcttgctgaggtctcgctagcctaggtgggtagtttcctggctgtggaggcctggcggggatgggatctgcctggctttcacgggtctctgccccgcagtgctctaccacctgtggcctgggtgcggtctggaggccggtgcgctgtagctccggccgggatgaggactgcgcccccgctggccggccccagcctgcccgccgctgccacctgcggccctgtgccacctggcactcaggcaactggagtaagtgctcccgcagctgcggcggaggttcctcagtgcgggacgtgcagtgtgtggacacacgggacctccggccactgcggcccttccattgtcagcccgggcctgccaagccgcctgcgcaccggccctgcggggcccagccctgcctcag

SEQ ID NO: 457 - DNA, 1655 bp, Homo sapiens
  ENST00000566303
cgaccggacgggacggacgagagcgtgcgcgcggggtcacccggcggccgcccggttcctgccatgcccggcggccccagtccccgcagccccgcgcctttgctgcgccccctcctcctgctcctctgcgctctggctcccggcgcccccggacccgcaccaggacgtgcaaccgagggccgggcggcactggacatcgtgcacccggttcgagtcgacgcggggggctccttcctgtcctacgagctgtggccccgcgcactgcgcaagcgggatgtatctgtgcgccgagacgcgcccgccttctacgagctacaataccgcgggcgcgagctgcgcttcaacctgaccgccaatcagcacctgctggcgcccggctttgtgagcgagacgcggcggcgcggcggcctgggccgcgcgcacatccgggcccacaccccggcctgccacctgcttggcgaggtgcaggaccctgagctcgagggtggcctggcggccatcagcgcctgcgacggcctgaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtggctggcctgtttcatgaccccagcattgggaaccccatccacatcaccattgtgcgcctggtcctgctggaagatgaggaggaggacctaaagatcacgcaccatgcagacaacaccctgaagagcttctgcaagtggcagaaaagcatcaacatgaagggggatgcccatcccctgcaccatgacactgccatcctgctcaccagaaaggacctgtgtgcagccatgaaccggccctgtgagaccctgggactgtcccatgtggcgggcatgtgccagccgcaccgcagctgcagcatcaacgaggacacgggcctgccgctggccttcactgtagcccacgagctcgggcacagctcctgtacgacgccgctcccctcacctggtcccgctgcagccgccagtatatcaccaggttccttgagtgtgcagaggcagaatgtgtactgcttggagcggcaggcagggcccgtggacgaggagcactgtgaccccctgggccggcctgatgaccaacagaggaagtgcagcgagcagccctgccctgccagtgctcagtgacatgtggggagggcactcagcgccgaaatgtcctctgcaccaatgacaccggtgtcccctgtgacgaggcccagcagccagccagcgaagtcacctgctctctgccactctgtcggtggcccctgggcacactgggccctgaaggctcaggcagcggctcctccagccacgagctcttcaacgaggctgacttcatcccgcaccacctg

SEQ ID NO: 458 - DNA, 4249 bp, Homo sapiens
  ENST00000565793
gtgcaaccgagggccgggcggcactggacatcgtgcacccggttcgagtcgacgcggggggctccttcctgtcctacgagctgtggccccgcgcactgcgcaagcgggatgtatctgtgcgccgagacgcgcccgccttctacgagctacaataccgcgggcgcgagctgcgcttcaacctgaccgccaatcagcacctgctggcgcccggctttgtgagcgagacgcggcggcgcggcggcctgggccgcgcgcacatccgggcccacaccccggcctgccacctgcttggcgaggtgcaggaccctgagctcgagggtggcctggcggccatcagcgcctgcgacggcctgaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtggctggcctgtttcatgaccccagcattgggaaccccatccacatcaccattgtgcgcctggtcctgctggaagatgaggaggaggacctaaagatcacgcaccatgcagacaacaccctgaagagcttctgcaagtggcagaaaagcatcaacatgaagggggatgcccatcccctgcaccatgacactgccatcctgctcaccagaaaggacctgtgtgcagccatgaaccggccctgtgagaccctgggactgtcccatgtggcgggcatgtgccagccgcaccgcagctgcagcatcaacgaggacacgggcctgccgctggccttcactgtagcccacgagctcgggcacagttttggcattcagcatgacggaagcggcaatgactgtgagcccgttgggaaacgacctttcatcatgtctccacagctcctgtacgacgccgctcccctcacctggtcccgctgcagccgccagtatatcaccaggttccttgaccgtgggtggggcctgtgcctggacgaccctcctgccaaggacattatcgacttcccctcggtgccacctggcgtcctctatgatgtaagccaccagtgccgcctccagtacggggcctactctgccttctgcgaggacatggatgtgagtggggccggtgtgggtgtgggggtgtggggacccggcaggagggctcagggggcagctctcaccagcccgtggatgccagcctgggagcaacctctcctggcctgggctgcgcccctgagtgacactgtgagacgtcaagtggcctgtgggagaggccagggatgggcggccacagacccagctctgaattctgggtcaaccatggaccaactgtgacccttcggacaagtcccttcgcctctctggagctggcttataagagggaaaaggaacccctgtggagagggtctgtttatcctggcgaagatcgcctgaagtgatcttctaacaggagtgtttccagaggaggggctgggccgggagaggtgtggacagctggggaccgctctgagcagcgcagccccgggcgccccacaccaccacatggtccggggaggaaggtgggagcaggcacacaagaaggaacctctgggggtctgtgggcccctgccatgtggaggggtgcccaggggacccttggggacagggaggggggcagggtgggtggcggcactggggagggtgtgagggtatggcccatgccctcctcctcgcagaatgtctgccacacactctggtgctctgtggggaccacctgtcactccaagctggatgcagctgtggacggcacccggtgtggggagaataaggtaggggatgtccccagtcccggcagtgggtgtgtgagaggccagacttcctgctgtgaccaggccctggggtcagccccggctcacagtcttgcttgtgctcctagcagagccccacgctctctgcagcccaagcccccatctgcaaagtggaggcattggggccagggcttgattccatgattccccagggtgtcttcagctgagtcagcatgtgggctgttttactccccgctcagctcctccatgtggcctgggtcacagatgattgtgatgattgtgagggtgcctctctcaccttccatccttcccctctgtgcctttcgcagccttcccacccaccttgttctcactagggtgaggatgactgatagacttgggggtggggtggctctacctccgtctgtctcagtagtggtgtctcagtggggagtgcgtacccgtgggcttccggcccgaggccgtggatggtggctggtctggctggagcgcctggtccatctgctcacggagctgtggcatgggcgtacagagcgccgagcggcagtgcacgcagcctacgcccaaatacaaaggcagatactgtgtgggtgagcgcaagcgcttccgcctctgcaacctgcaggcctgccctgctggccgcccctccttccgccacgtccagtgcagccactttgacgctatgctctacaagggccagctgcacacatgggtgcccgtggtcaatgacgtgaacccctgcgagctgcactgccggcccgcgaatgagtactttgccgagaagctgcgggacgccgtggtcgatggcaccccctgctaccaggtccgagccagccgggacctctgcatcaacggcatctgtaagaacgtgggctgtgacttcgagattgactccggtgctatggaggaccgctgtggtgtgtgccacggcaacggctccacctgccacaccgtgagcgggaccttcgaggaggccgagggcctggggtatgtggatgtggggctgatcccagcgggcgcacgcgagatccgcatccaagaggttgccgaggctgccaacttcctggcactgcggagcgaggacccggagaagtacttcctcaatggtggctggaccatccagtggaacggggactaccaggtggcagggaccaccttcacatacgcacgcaggggcaactgggagaacctcacgtccccgggtcccaccaaggagcctgtctggatccaggtgcctgcctcccgtggcccaggcggggggagcagaggcggagtccccaggcccagcaccctccatggcaggtctcgtcctggaggagtgagccctggttcagtcacagagcctggctctgagccaggccctcctgctgcggcctctacctcagtttccccatctttaaaatggcccaatcttgtagctgcagttcacagaggtggctggggtcagctcctttaggactgggtggatggagaagacaccttgtgctcatgggcccccgcctgcccacccagctgctgttccaggagagcaaccctggggtgcactacgagtacaccatccacagggaggcaggtggccacgacgaggtcccgccgcccgtgttctcctggcattatgggccctggaccaagtgcacagtcacctgcggcagaggtgagaagtggggcaggcacagccccacctgcaggggcttagtgtctggacagggacactggcttcagctcccagctcactgctgggccaccacgggtttggaagtttgcttctctgagcctcagttctccatctgtgagatgaggctagcgattgccctgtgtcccaggcccgctgggagggtacatggatgaggcaggtgggtgctggctcgcggcgcatgttcagtgtgctccagctcttggcgttctccctccaggggacacagctccccctcgatagaccagtccagtggcccctcaccacactgacttatttccctaaactatttataaaaagtagggcaatttcattaactctgactcttcctccccaaatttccctctctccccatgctcctcagtcccctctctctctgtctcctccccactgctcctcagtctcccctctggccctctgtctcctcccatactcctcagtctccccgcatgcctctcagtctcccccatacccctcggtctccccccatacccctc

SEQ ID NO: 459 - DNA, 3178 bp, Homo sapiens
  ENST00000568712
ccggttcctgccatgcccggcggccccagtccccgcagccccgcgcctttgctgcgccccctcctcctgctcctctgcgctctggctcccggcgcccccggacccgcaccaggacgtgcaaccgagggccgggcggcactggacatcgtgcacccggttcgagtcgacgcggggggctccttcctgtcctacgagctgtggccccgcgcactgcgcaagcgggatgtatctgtgcgccgagacgcgcccgccttctacgagctacaataccgcgggcgcgagctgcgcttcaacctgaccgccaatcagcacctgctggcgcccggctttgtgagcgagacgcggcggcgcggcggcctgggccgcgcgcacatccgggcccacaccccggcctgccacctgcttggcgaggtgcaggaccctgagctcgagggtggcctggcggccatcagcgcctgcgacggcctgaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtggctggcctgtttcatgaccccagcattgggaaccccatccacatcaccattgtgcgcctggtcctgctggaagatgaggaggaggacctaaagatcacgcaccatgcagacaacaccctgaagagcttctgcaagtggcagaaaagcatcaacatgaagggggatgcccatcccctgcaccatgacactgccatcctgctcaccagaaaggacctgtgtgcagccatgaaccggccctgtgagaccctgggactgtcccatgtggcgggcatgtgccagccgcaccgcagctgcagcatcaacgaggacacgggcctgccgctggccttcactgtagcccacgagctcgggcacagttttggcattcagcatgacggaagcggcaatgactgtgagcccgttgggaaacgacctttcatcatgtctccacagctcctgtacgacgccgctcccctcacctggtcccgctgcagccgccagtatatcaccaggttccttgaccgtgggtggggcctgtgcctggacgaccctcctgccaaggacattatcgacttcccctcggtgccacctggcgtcctctatgatgtaagccaccagtgccgcctccagtacggggcctactctgccttctgcgaggacatggataatgtctgccacacactctggtgctctgtggggaccacctgtcactccaagctggatgcagctgtggacggcacccggtgtggggagaataagtggtgtctcagtggggagtgcgtacccgtgggcttccggcccgaggccgtggatggtggctggtctggctggagcgcctggtccatctgctcacggagctgtggcatgggcgtacagagcgccgagcggcagtgcacgcagcctacgcccaaatacaaaggcagatactgtgtgggtgagcgcaagcgcttccgcctctgcaacctgcaggcctgccctgctggccgcccctccttccgccacgtccagtgcagccactttgacgctatgctctacaagggccagctgcacacatgggtgcccgtggtcaatgacgtgaacccctgcgagctgcactgccggcccgcgaatgagtactttgccgagaagctgcgggacgccgtggtcgatggcaccccctgctaccaggtccgagccagccgggacctctgcatcaacggcatctgtaagaacgtgggctgtgacttcgagattgactccggtgctatggaggaccgctgtggtgtgtgccacggcaacggctccacctgccacaccgtgagcgggaccttcgaggaggccgagggcctggggtatgtggatgtggggctgatcccagcgggcgcacgcgagatccgcatccaagaggttgccgaggctgccaacttcctggcactgcggagcgaggacccggagaagtacttcctcaatggtggctggaccatccagtggaacggggactaccaggtggcagggaccaccttcacatacgcacgcaggggcaactgggagaacctcacgtccccgggtcccaccaaggagcctgtctggatccaggtgcctgcctcccgtggcccaggcggggggagcagaggcggagtccccaggcccagcaccctccatggcaggtctcgtcctggaggagtgagccctggttcagtcacagagcctggctctgagccaggccctcctgctgcggcctctacctcagtttccccatctttaaaatggcccaatcttgtagctgcagttcacagaggtggctggggtcagctcctttaggactgggtggatggagaagacaccttgtgctcatgggcccccgcctgcccacccagctgctgttccaggagagcaaccctggggtgcactacgagtacaccatccacagggaggcaggtggccacgacgaggtcccgccgcccgtgttctcctggcattatgggccctggaccaagtgcacagtcacctgcggcagaggtgagaagtggggcaggcacagccccacctgcaggggcttagtgtctggacagggacactggcttcagctcccagctcactgctgggccaccacgggtttggaagtttgcttctctgagcctcagttctccatctgtgagatgaggctagcgattgccctgtgtcccaggcccgctgggagggtacatggatgaggcaggtgggtgctggctcgcggcgcatgttcagtgtgctccagctcttggcgttctccctccaggggacacagctccccctcgatagaccagtccagtggcccctcaccacactgacttatttccctaaactatttataaaaagtagggcaatttcattaactctgactctt

SEQ ID NO: 460 - DNA, 7624 bp, Homo sapiens
  ENST00000498707
acagggcgcccggcgcgcctcggagcgcaagttcctcgccttctcctgcccgctcgctgggcattatgcggccaagcagccgagccccagtcctcctcctcctcctgctcctccggctcctcctgcggcccgagcggctcagctctcggcaggcggcggcgttgctcagccgagcgcagacgggaccctcgcagcgagacctcagcgactcctaaagtcaaaagttggcggcgggcgccgggctccgcgcgctctccacggccgctgcctcgcgtcgccgccgcagccaaggagggcaggagggaggggggtgggggcagcggagggaggggtgggaagcaccatgcagtttgtatcctgggccacactgctaacgctcctggtgcgggacctggccgagatggggagcccagacgccgcggcggccgtgcgcaaggacaggctgcacccgaggcaagtgaaattattagagaccctgagcgaatacgaaatcgtgtctcccatccgagtgaacgctctcggagaaccctttcccacgaacgtccacttcaaaagaacgcgacggagcattaactctgccactgacccctggcctgccttcgcctcctcctcttcctcctctacctcctcccaggcgcattaccgcctctctgccttcggccagcagtttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggcgcttggagtcagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagctgctcagtgtcttgtggtgttggagtgatgcagagatctgtgcaatgtttaaccaatgaggaccaacccagccacttatgccacactgatctgaagccagaagaacgaaaaacctgccgtaatgtctataactgtgagttaccccagaattgcaaggaggtaaaaagacttaaaggtgccagtgaagatggtgaatatttcctgatgattagaggaaagcttctgaagatattctgtgcggggatgcactctgaccaccccaaagagtacgtgacactggtgcatggagactctgagaatttctccgaggtttatgggcacaggttacacaacccaacagaatgtccctataacgggagccggcgcgatgactgccaatgtcggaaggattacacggccgctgggttttccagttttcagaaaatcagaatagacctgaccagcatgcagataatcaccactgacttacagtttgcaaggacaagcgaaggacatcccgtcccttttgccacagccggggattgctacagcgctgccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggtgctttgaagaggaagccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaatgatgtaaagtttaatatttatgtttgaaattatttattgtgatgtaatatttttgtacgtaaaatgattctattatgactgcctttgcatgtagtaatatgacaaagtgatccttcattatcacggtacactattgtttacttttcatctgtaaatgttttattgttacttttttaaaatgaatttttttaaaacaatctagccatcatcaaggtgctataagagttgtataaaagatatttttggcatttctaggcaagtatcagccaataagtatgttagtgatatcacagattgtaccaactattaactatgttaaataagtattcagtttcatgtgatctctgggaaaaaaatatgctgccttggtgctaatattgtatgtatttaaatgatcatccgactcagaaatataaacacttttaatgaaagggaggaacggaaggacaatttccagtgcacagaatcacttggatgaaataagaccagctctttacccttatttttggatatgccttttttggaagagacttagactttatccttattgttgttagtgttgttaatattcgttgcttcagcccacggtgccttggtctctccacaatcaaatggaggatcccccaagcagcttcattacagagtgatattgggaaagtgagatcctctcaccattttgccaagatactctaaaatgacatccaagtttaccagtagaaagacacaggatgcacagaatgggcatgaccttcagctcacgagcacacctggagaaattcagaaccaggttctgaatcatcacgattgccttttgcatgaaaacatcggctggtgatgtgacttctcttcaggccatgagcctaacaccctgccggttttcatgcccgctgcagtaatggacgtttgtgtgaagaaatgaactgtggagtacaaaatgctttgagtctttccgattgctcattaattcacttttttgttacttctttccaaaatggaagtgctgaagccatggtctttctgcccctccaagctgatgaagggaagcctttgccaatggcccatggaagacacttggtttgagaaaccctgcccacttccaaagaccaaagagattaggaaaagcctggcagtattctccaactccaaacaagctctagagtgctccaggaaaagttatattcagtatatgaataagtgttattctccattattaatgtgttctgaaaatatattatgaataaatacatcaccacacccaaa

SEQ ID NO: 461 - DNA, 1811 bp, Homo sapiens
  ENST00000477180
tttctcaattatttaaaaatataaaaatcatccttagcttgcaagccatacagaaacaggtggtgggctggatttggctcacaggctgaagtttgccagcccctgctttagaccatggtgagtatgttgggcttcacatcagttcagaaggcctgtttactgtgtgtataagaacgttttcccaaaaagccagtgcaggccctgaaagcattaaccaagcaggcaggctaacatgatgcatctccttgcaggatggtacccgagtcgtagggaaatgcggtggttactgtggaaaatgcactccatcctctggtactggcctggaggtgcgagttttatagctaaggtgctttgaagaggaagccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaatgatgtaaagtttaatatttatgtttgaaattatttattgtgatgtaatatttttgtacgtaaaatgattctattatgactgcctttgcatgtagtaatatgacaaagtgatccttcattatcacggtacactattgtttacttttcatctgtaaatgttttattgttacttttttaaaatgaatttttttaaaacaatctagccatcatcaaggtgctataagagttgtataaaagatatttttggcatttctaggcaagtatcagccaataagtatgttagtgatatcacagattgtaccaactattaactatgttaaataagtattcagtttcatgtgatctctgggaaaaaaatatgctgccttggtgctaatattgtatgtatttaaatgatcatccgactcagaaatataaacacttttaatgaaagggaggaacggaaggacaatttccagtgcacagaatcacttggatgaaataagaccagctctttacccttatttttggatatgccttttttggaagagacttagactttatccttattgttgttagtgttgttaatattcgttgcttcagcccacggtgccttggtctctccacaatcaaatggaggatcccccaagcagcttcattacagagtgatattgggaaagtgagatcctctcaccattttgccaagatactctaaaatgacatccaagtttaccagtagaaagacacaggatgcacagaatgggcatgaccttcagctcacgagcacacctggagaaattcagaaccaggttctgaatcatcacgattgccttttgcatgaaaacatcggctggtgatgtgacttctcttcaggccatgagcctaacaccctgccggttttcatgcccgctgcagtaatggacgtttgtgtgaagaaatgaactgtggagtacaaaatgctttgagtctttccgattgctcattaattcacttttttgttacttctttccaaaatggaagtgctgaagccatggtctttctgcccctccaagctgatgaagggaagcctttgccaatggcccatggaagacacttggtttgagaaaccctgcccacttccaaagaccaaagagattaggaaaagcctggcagtattctccaactccaaacaagctctagagtgctccaggaaaagttatattcagtatatgaataagtgttattctccattattaatgtgttctgaaaatatattatgaataaatacatcaccacaccc

SEQ ID NO: 462 - DNA, 7060 bp, Homo sapiens
  ENST00000295903
ggagggaggggtgggaagcaccatgcagtttgtatcctgggccacactgctaacgctcctggtgcgggacctggccgagatggggagcccagacgccgcggcggccgtgcgcaaggacaggctgcacccgaggcaagtgaaattattagagaccctgagcgaatacgaaatcgtgtctcccatccgagtgaacgctctcggagaaccctttcccacgaacgtccacttcaaaagaacgcgacggagcattaactctgccactgacccctggcctgccttcgcctcctcctcttcctcctctacctcctcccaggcgcattaccgcctctctgccttcggccagcagtttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggcgcttggagtcagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagctgctcagtgtcttgtggtgttggagtgatgcagagatctgtgcaatgtttaaccaatgaggaccaacccagccacttatgccacactgatctgaagccagaagaacgaaaaacctgccgtaatgtctataactgtgagttaccccagaattgcaaggaggtaaaaagacttaaaggtgccagtgaagatggtgaatatttcctgatgattagaggaaagcttctgaagatattctgtgcggggatgcactctgaccaccccaaagagtacgtgacactggtgcatggagactctgagaatttctccgaggtttatgggcacaggttacacaacccaacagaatgtccctataacgggagccggcgcgatgactgccaatgtcggaaggattacacggccgctgggttttccagttttcagaaaatcagaatagacctgaccagcatgcagataatcaccactgacttacagtttgcaaggacaagcgaaggacatcccgtcccttttgccacagccggggattgctacagcgctgccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggtgctttgaagaggaagccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaatgatgtaaagtttaatatttatgtttgaaattatttattgtgatgtaatatttttgtacgtaaaatgattctattatgactgcctttgcatgtagtaatatgacaaagtgatccttcattatcacggtacactattgtttacttttcatctgtaaatgttttattgttacttttttaaaatgaatttttttaaaacaatctagccatcatcaaggtgctataagagttgtataaaagatatttttggcatttctaggcaagtatcagccaataagtatgttagtgatatcacagattgtaccaactattaactatgttaaataagtattcagtttcatgtgatctctgggaaaaaaatatgctgccttggtgctaatattgtatgtatttaaatgatcatccgactcagaaatataaacacttttaatgaaagggaggaacggaaggacaatttccagtgcacagaatcacttggatgaaataagaccagctctttacccttatttttggatatgccttttttggaagagacttagactttatccttattgttgttagtgttgttaatattcgttgcttcagcccacggtgccttggtctctccacaatcaaatggaggatcccccaagcagcttcattacagagtgatattgggaaagtgagatcctctcaccattttgccaagatactctaaaatgacatccaagtttaccagtagaaagacacaggatgcacagaatgggcatgaccttcagctcacgagcacacctggagaaattcagaaccaggttctgaatcatcacgattgccttttgcatgaaaacatcggctggtgatgtgacttctcttcaggccatgagcctaacaccctgccggttttcatgcccgctgcagtaatggacgtttgtgtgaagaaatgaactgtggagtacaaaatgctttgagtctttccgattgctcattaattcacttttttgttacttctttccaaaatggaagtgctgaagccatggtctttctgcccctccaagctgatgaagggaagcctttgccaatggcccatggaagacacttggtttgagaaaccctgcccacttccaaa

SEQ ID NO: 463 - DNA, 597 bp, Homo sapiens
  ENST00000467257
gccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggaaaattgcctccagctgcatccatattgctgcaaaggacatgatttcattattttttatggctgcatagtatttcatcatgtatacagaccacatttttaaaatccagtccaccattaatcggtacctaggttgattccacgtttgctattgtgaatagtgctgcaataaacatgtgctttgaagaggaagccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaa

SEQ ID NO: 464 - DNA, 3168 bp, Homo sapiens
  ENST00000481060
gtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggcgcttggagtcagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagctgctcagtgtcttgtggtgttggagtgatgcagagatctgtgcaatgtttaaccaatgaggaccaacccagccacttatgccacactgatctgaagccagaagaacgaaaaacctgccgtaatgtctataactgtgagttaccccagaattgcaaggaggtaaaaagacttaaaggtgccagtgaagatggtgaatatttcctgatgattagaggaaagcttctgaagatattctgtgcggggatgcactctgaccaccccaaagagtacgtgacactggtgcatggagactctgagaatttctccgaggtttatgggcacaggttacacaacccaacagaatgtccctataacgggagccggcgcgatgactgccaatgtcggaaggattacacggccgctgggttttccagttttcagaaaatcagaatagacctgaccagcatgcagataatcaccactgacttacagtttgcaaggacaagcgaaggacatcccgtcccttttgccacagccggggattgctacagcgctgccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggaaaattgcctccagctgcatccatattgctgcaaaggacatgatttcattattttttatggctgcatagtatttcatcatgtatacagaccacatttttaaaatccagtccaccattaatcggtacctaggttgattccacgtttgctattgtgaatagtgctgcaataaacatgtgagtgcaggtg

SEQ ID NO: 465 - DNA, 5139 bp, Homo sapiens
  ENST00000482490
caactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggcgcttggagtcagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagaggtaccgtcctgggaactgtaaccatcgtcagctcagccatggcctgagagtggcagagggatgagtggagggatgagtgcaggaatgtgggagacttgaggctacccgcccgatttgccactgtgaactgtgtgttttctgacaagtcctcagctttcccaagctagaattccttgtatgcaaagcgggagagatgtaagagatggtctctaagtcccttcaggtctacattctgtgattcaccttgatgtcctattggcataaagaagaaattattacaggggctgcaaactcataggatgctgtgaggtgcctgaagacagttaagtataagaaaatactgtagtgccagggatacaacaaggagagatggcaactgtgacaaactagcacatgctgtgtgaagggagcagaatctctttcactccagctgtggccatgcagaaatgtggtctagcgttaccagacctgatttttcaagagaggctaaaaatctggactagtatgtgagatttcctaacttgaaaatgggggctgaaatttttggttttaaaacattgtaaggggcaaacaaacccctttcatgaaccagatgtgttgtgcctgtttaacaaacagcttcagaggaagaaaataattttctataatatccgaagtatctcaagtaccattttttcatatatcttcctgtgcacagtgcttatctagaccctttttaatggtaataaaccagtagtaatcat

SEQ ID NO: 466 - DNA, 3662 bp, Homo sapiens
  ENST00000475557
gggaagcaccatgcagtttgtatcctgggccacactgctaacgctcctggtgcgggacctggccgagatggggagcccagacgccgcggcggccgtgcgcaaggacaggctgcacccgaggcaagtgaaattattagagaccctgagcgaatacgaaatcgtgtctcccatccgagtgaacgctctcggagaaccctttcccacgaacgtccacttcaaaagaacgcgacggagcattaactctgccactgacccctggcctgccttcgcctcctcctcttcctcctctacctcctcccaggcgcattaccgcctctctgccttcggccagcagtttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagaggtaagatgggagggctgttatttcccctaggtcatctcttacattctagttctggtgctctctatctgtttaagacaaacccttgtgcacctttctcccacctctccctttctcccttgtctcccttgagaaaacaactccagttctctgcctgcaccatgactgtcgtactggatgtaactagtctaccagtgacctcagggcactttgggcttggctagatcactcactgttgtagcttctgttgtgattttgaagttgcagtccatcaccttccctcctctttgagccctagctaagtcactgaaaggaaatcatggatttattaatcataaagctatactagctcacatctgaagtcaacatgaagtttcctacttccttgtctttgaaataagagaattagaccccagggagtgacctctctgacttacccatccaactgcaagaaaaaaaaataaaa

SEQ ID NO: 467 - DNA, 2871 bp, Homo sapiens
  ENST00000459780
cggcgcgcctcggagcgcaagttcctcgccttctcctgcccgctcgctgggcattatgcggccaagcagccgagccccagtcctcctcctcctcctgctcctccggctcctcctgcggcccgagcggctcagctctcggcaggcggcggcgttgctcagccgagcgcagacgggaccctcgcagcgagacctcagcgactcctaaagtcaaaagttggcggcgggcgccgggctccgcgcgctctccacggccgctgcctcgcgtcgccgccgcagccaaggagggcaggagggaggggggtgggggcagcggagggaggggtgggaagcaccatgcagtttgtatcctgggccacactgctaacgctcctggtgcgggacctggccgagatggggagcccagacgccgcggcggccgtgcgcaaggacaggctgcacccgaggcaagtgaaattattagagaccctgagcgaatacgaaatcgtgtctcccatccgagtgaacgctctcggagaaccctttcccacgaacgtccacttcaaaagaacgcgacggagcattaactctgccactgacccctggcctgccttcgcctcctcctcttcctcctctacctcctcccaggcgcattaccgcctctctgccttcggccagcagtttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagagtaagacttgaacattcttttagcacaaacttctagtgcctggcctacatgtagtgaactaattgtgggaaagacaatatgaagtcaaacattccttttgagttatttttgttgacattccttggagaaggcaaaaaaaaaaaaaaaaagctctctgacatctgtgtagttcatatccttgacagagtttagaagattacagactgagctaaagaaaaggttggagtcttaaagaggatgtggaaatgttgcttcattttgggtaaagttttgagatttgttcagacattgggagagggactatgaatgtgatttcttaatgaaggccacaggtatttatgcacttctaatttagtaatttgggcctgaaaaggggtggggtagtgagatgatcccaaagcagattccgtggatgagtggaaattacagcagctcccacattgttgagttgaggacattctctctctgcgtcactcttcctctccccctcttccctctcccttttctcttttttcccatttcctttcttttcttgttttgttttttaagcttcctgctaggctgctcaaagatccaattacattatacaatgcccctgtgtcacagatttattgctcttctcgctcagaagtatgaaaggttaagtgattgtcccagagtcactgggtgtatatttctgcaaccacggggaagaggaggctttatcaatcagaactcaacgggtgtgaattttccgggagaggtgtttgctgaaaacggaaagaaccagagggttgctgttgttctttttaaccagatggtgtaaggtgttttctttctatgagtcattgattcgctcacgcatcccttcagcaaacatttactaatcacctgttgtcatggacagggccctgtgctttgatgaaaaagacactatctttgcccttagaaagcttacagtctattgggaaagatagtcaaacataaacagataattgctgtgaagtgtgatcaacgttgtaacaggtgtatatttcctactggctatgttgtattcattgcatgtggttctacaaagtaaacagcaaaaatgtaa

SEQ ID NO: 468 - DNA, 476 bp, Homo sapiens
  ENST00000467119
aaagtatttacttgtattgacatttactctttgatgtcatcaaggcctaagtctgctttgctttcagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagagtaagacttgaacattcttttagcacaaacttctagtgcctggcctacatgtagtgaactaattgtgggaaagacaatatgaagtcaaacattccttttgagttatttttgttga

SEQ ID NO: 469 - DNA, 579 bp, Homo sapiens
  ENST00000494004
atgaagagactttacaaaaagtgttgttgagtgaatgaaaaattcacaaccacaaaatgcatatgttgcaagaaacgtaaaaaagaggtggagcccaacgtaagacgtgacttgcttattgcttacacggagttcacaattaactttgaaaaatttatctcggttgcaggtagcctctatctataaagacccaagtattggaaatttaattaatattgttattgtgaacttaattgtgattcataatgaacaggtaataaagtttttttcttttttcttctatctgtatccgaaatggcatatctaattgggatcggtacaacagattaaccataattcttctctgtatttaggatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattga

SEQ ID NO: 470 - DNA, 7336 bp, Homo sapiens
  ENST00000286744
cccagccccatttaacttcgcggcggcggcggcgactgcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggctacaactgagacccggaggagactagaccccatggcttcctggacgagcccctggtgggtgctgatagggatggtcttcatgcactctcccctcccgcagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctgaaaaaagagaagaaaatgtaattgctgttcctttgggaagtcgaagtgtgagaattacagtgaaaggacctgcccacctctttattgaatcaaaaacacttcaaggaagcaaaggagaacacagctttaacagccccggcgtctttctcgtagaaaacacaacagtggaatttcagaggggctccgagaggcaaacttttaagattccaggacctctgatggctgatttcatcttcaagaccaggtacactgcagccaaagacagcgtggttcagttcttcttttaccagcccatcagtcatcagtggagacaaactgacttctttccctgcactgtgacgtgtggaggaggttatcagctcaattctgctgaatgtgtggatatccgcttgaagagggtagttcctgaccattattgtcactactaccctgaaaatgtaaaaccaaaaccaaaactgaaggaatgcagcatggatccctgcccatcaagtgatggatttaaagagataatgccctatgaccacttccaacctcttcctcgctgggaacataatccttggactgcatgttccgtgtcctgtggaggagggattcagagacggagctttgtgtgtgtagaggaatccatgcatggagagatattgcaggtggaagaatggaagtgcatgtacgcacccaaacccaaggttatgcaaacttgtaatctgtttgattgccccaagtggattgccatggagtggtctcagtgcacagtgacttgtggccgagggttacggtaccgggttgttctgtgtattaaccaccgcggagagcatgttgggggctgcaatccacaactgaagttacacatcaaagaagaatgtgtcattcccatcccgtgttataaaccaaaagaaaaaagtccagtggaagcaaaattgccttggctgaaacaagcacaagaactagaagagaccagaatagcaacagaagaaccaacgttcattccagaaccctggtcagcctgcagtaccacgtgtgggccgggtgtgcaggtccgtgaggtgaagtgccgtgtgctcctcacattcacgcagactgagactgagctgcccgaggaagagtgtgaaggccccaagctgcccaccgaacggccctgcctcctggaagcatgtgatgagagcccggcctcccgagagctagacatccctctccctgaggacagtgagacgacttacgactgggagtacgctgggttcaccccttgcacagcaacatgcgtgggaggccatcaagaagccatagcagtgtgcttacatatccagacccagcagacagtcaatgacagcttgtgtgatatggtccaccgtcctccagccatgagccaggcctgtaacacagagccctgtccccccaggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaagtgttctgtcagttgtggtgttggaatccagagaagaaagcaggtgtgtcaaaggctggcagccaaaggtcggcgcatccccctcagtgagatgatgtgcagggatctaccagggctccctcttgtaagatcttgccagatgcctgagtgcagtaaaatcaaatcagagatgaagacaaaacttggtgagcagggtccgcagatcctcagtgtccagagagtctacattcagacaagggaagagaagcgtattaacctgaccattggtagcagagcctatttgctgcccaacacatccgtgattattaagtgccccgtgcgacgattccagaaatctctgatccagtgggagaaggatggccgttgcctgcagaactccaaacggcttggcatcaccaagtcaggctcactaaaaatccatggtcttgctgcccccgacatcggcgtgtaccggtgcattgcaggctctgcacaggaaacagttgtgctcaagctcattggtactgacaaccggctcatcgcacgcccagccctcagggagcctatgagggaatatcctgggatggaccacagcgaagccaatagtttgggagtcacatggcacaaaatgaggcaaatgtggaataacaaaaatgacctttatctggatgatgaccacattagtaaccagcctttcttgagagctctgttaggccactgcagcaattctgcaggaagcaccaactcctgggagttgaagaataagcagtttgaagcagcagttaaacaaggagcatatagcatggatacagcccagtttgatgagctgataagaaacatgagtcagctcatggaaaccggagaggtcagcgatgatcttgcgtcccagctgatatatcagctggtggccgaattagccaaggcacagccaacacacatgcagtggcggggcatccaggaagagacacctcctgctgctcagctcagaggggaaacagggagtgtgtcccaaagctcgcatgcaaaaaactcaggcaagctgacattcaagccgaaaggacctgttctcatgaggcaaagccaacctccctcaatttcatttaataaaacaataaattccaggattggaaatacagtatacattacaaaaaggacagaggtcatcaatatactgtgtgaccttattacccccagtgaggccacatatacatggaccaaggatggaaccttgttacagccctcagtaaaaataattttggatggaactgggaagatacagatacagaatcctacaaggaaagaacaaggcatatatgaatgttctgtagctaatcatcttggttcagatgtggaaagttcttctgtgctgtatgcagaggcacctgtcatcttgtctgttgaaagaaatatcaccaaaccagagcacaaccatctgtctgttgtggttggaggcatcgtggaggcagcccttggagcaaacgtgacaatccgatgtcctgtaaaaggtgtccctcagcctaatataacttggttgaagagaggaggatctctgagtggcaatgtttccttgcttttcaatggatccctgttgttgcagaatgtttcccttgaaaatgaaggaacctacgtctgcatagccaccaatgctcttggaaaggcagtggcaacatctgtactccacttgctggaacgaagatggccagagagtagaatcgtatttctgcaaggacataaaaagtacattctccaggcaaccaacactagaaccaacagcaatgacccaacaggagaacccccgcctcaagagcctttttgggagcctggtaactggtcacattgttctgccacctgtggtcatttgggagcccgcattcagagaccccagtgtgtgatggccaatgggcaggaagtgagtgaggccctgtgtgatcacctccagaagccactggctgggtttgagccctgtaacatccgggactgcccagcgaggtggttcacaagtgtgtggtcacagtgctctgtgtcttgcggtgaaggataccacagtcggcaggtgacgtgcaagcggacaaaagccaatggaactgtgcaggtggtgtctccaagagcatgtgcccctaaagaccggcctctgggaagaaaaccatgttttggtcatccatgtgttcagtgggaaccagggaaccggtgtcctggacgttgcatgggccgtgctgtgaggatgcagcagcgtcacacagcttgtcaacacaacagctctgactccaactgtgatgacagaaagagacccaccttaagaaggaactgcacatcaggggcctgtgatgtgtgttggcacacaggcccttggaagccctgtacagcagcctgtggcaggggtttccagtctcggaaagtcgactgtatccacacaaggagttgcaaacctgtggccaagagacactgtgtacagaaaaagaaaccaatttcctggcggcactgtcttgggccctcctgtgatagagactgcacagacacaactcactactgtatgtttgtaaaacatcttaatttgtgttctctagaccgctacaaacaaaggtgctgccagtcatgtcaagagggataaacctttggaggggtcatgatgctgctgtgaagataaaagtagaatataaaagctcttttccccatgtcgctgattcaaaaacatgtatttcttaaaagactagattctatggatcaaacagaggttgatgcaaaaacaccactgttaaggtgtaaagtgaaattttccaatggtagttttatattccaattttttaaaatgatgtattcaaggatgaacaaaatactatagcatgcatgccactgcacttgggacctcatcatgtcagttgaatcgagaaatcaccaagattatgagtgcatcctcacgtgctgcctctttcctgtgatatgtagactagcacagagtggtacatcctaaaaacttgggaaacacagcaacccatgacttcctcttctctcaagttgcaggttttcaacagttttataaggtatttgcattttagaagctctggccagtagttgttaagatgttggcattaatggcattttcatagatccttggtttagtctgtgaaaaagaaaccatctctctggataggctgtcacactgactgacctaagggttcatggaagcatggcatcttgtccttgcttttagaacacccatggaagaaaacacagagtagatattgctgtcatttatacaactacagaaatttatctatgacctaatgaggcatctcggaagtcaaagaagagggaaagttaaccttttctactgatttcgtagtatattcagagctttcttttaagagctgtgaatgaaactttttctaagcactattctattgcacacaaacagaaaaccaaagccttattagacctaatttatgcataaagtagtattcctgagaactttattttggaaaatttataagaaagtaatccaaataagaaacacgatagttgaaaataatttttatagtaaataattgttttgggctgatttttcagtaaatccaaagtgacttaggttagaagttacactaaggaccaggggttggaatcagaatttagtttaagatttgaggaaaagggtaagggttagtttcagttttaggattagagctagaattgggttaggtgagaaagaaagttaaggttaaggctagagttgtctttaagggttagggttaggaccaggttaggtcagggttggattgggtttagattggggccagtgctggtgttagtgatagtgtcaggatggaggttaggtttggagtaagcgttgttgctgaagtgagttcaggctagcattaaattgtaagttctgaagctgatttggttatggggtctttcccctgtatactaccagttgtgtctttagatggcacacaagtccaaataagtggtcatacttctttattcagggtctcagctgcctgtacacctgctgcctacatcttcttggcaacaaagttacctgccacaggctctgctgagcctagttcctggtcagtaataactgaacagtgcattttggctttggatgtgtctgtggacaagcttgctgagtttctctaccatattctgagcacacggtctcttttgttctaacttcagcttcactgacactgggttgagcactactgtatgtggagggtttggtgattgggaatggatgggggacagtgaggaggacacaccagcccattagttgttaatcatcaatcacatctgattgttgaaggttattaaattaaaagaaagatcatttgtaacatactctttgtatatatttattatatgaaaggtgcaatattttattttgtacagtatgtaataaagacatgggacatatatttttcttattaacaaaatttcatattaaattgcttcactttgtatttaaagttaaaagttactatttttcatttgctattgtactttcattgttgtcattcaattgacattcctgtgtactgtattttactactgtttttataacatgagagttaatgtttctgtttcatgatccttatgtaattcagaaataaatttactttgattattcagtggcatccttataaa

SEQ ID NO: 471 - DNA, 6873 bp, Homo sapiens
  ENST00000567476
cagccccatttaacttcgcggcggcggcggcgactgcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggctacaactgagacccggaggagactagaccccatggcttcctggacgagcccctggtgggtgctgatagggatggtcttcatgcactctcccctcccgcagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctgaaaaaagagaagaaaatgtaattgctgttcctttgggaagtcgaagtgtgagaattacagtgaaaggacctgcccacctctttattgaatcaaaaacacttcaaggaagcaaaggagaacacagctttaacagccccggcgtctttctcgtagaaaacacaacagtggaatttcagaggggctccgagaggcaaacttttaagattccaggacctctgatggctgatttcatcttcaagaccaggtacactgcagccaaagacagcgtggttcagttcttcttttaccagcccatcagtcatcagtggagacaaactgacttctttccctgcactgtgacgtgtggaggaggttatcagctcaattctgctgaatgtgtggatatccgcttgaagagggtagttcctgaccattattgtcactactaccctgaaaatgtaaaaccaaaaccaaaactgaaggaatgcagcatggatccctgcccatcaagtgatggatttaaagagataatgccctatgaccacttccaacctcttcctcgctgggaacataatccttggactgcatgttccgtgtcctgtggaggagggattcagagacggagctttgtgtgtgtagaggaatccatgcatggagagatattgcaggtggaagaatggaagtgcatgtacgcacccaaacccaaggttatgcaaacttgtaatctgtttgattgccccaagtggattgccatggagtggtctcagtgcacagtgacttgtggccgagggttacggtaccgggttgttctgtgtattaaccaccgcggagagcatgttgggggctgcaatccacaactgaagttacacatcaaagaagaatgtgtcattcccatcccgtgttataaaccaaaagaaaaaagtccagtggaagcaaaattgccttggctgaaacaagcacaagaactagaagagaccagaatagcaacagaagaaccaacgttcattccagaaccctggtcagcctgcagtaccacgtgtgggccgggtgtgcaggtccgtgaggtgaagtgccgtgtgctcctcacattcacgcagactgagactgagctgcccgaggaagagtgtgaaggccccaagctgcccaccgaacggccctgcctcctggaagcatgtgatgagagcccggcctcccgagagctagacatccctctccctgaggacagtgagacgacttacgactgggagtacgctgggttcaccccttgcacagcaacatgcgtgggaggccatcaagaagccatagcagtgtgcttacatatccagacccagcagacagtcaatgacagcttgtgtgatatggtccaccgtcctccagccatgagccaggcctgtaacacagagccctgtccccccaggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaagtgttctgtcagttgtggtgttggaatccagagaagaaagcaggtgtgtcaaaggctggcagccaaaggtcggcgcatccccctcagtgagatgatgtgcagggatctaccagggctccctcttgtaagatcttgccagatgcctgagtgcagtaaaatcaaatcagagatgaagacaaaacttggtgagcagggtccgcagatcctcagtgtccagagagtctacattcagacaagggaagagaagcgtattaacctgaccattggtagcagagcctatttgctgcccaacacatccgtgattattaagtgccccgtgcgacgattccagaaatctctgatccagtgggagaaggatggccgttgcctgcagaactccaaacggcttggcatcaccaagtcaggctcactaaaaatccatggtcttgctgcccccgacatcggcgtgtaccggtgcattgcaggctctgcacaggaaacagttgtgctcaagctcattggtactgacaaccggctcatcgcacgcccagccctcagggagcctatgagggaatatcctgggatggaccacagcgaagccaatagtttgggagtcacatggcacaaaatgaggcaaatgtggaataacaaaaatgacctttatctggatgatgaccacattagtaaccagcctttcttgagagctctgttaggccactgcagcaattctgcaggaagcaccaactcctgggagttgaagaataagcagtttgaagcagcagttaaacaaggagcatatagcatggatacagcccagtttgatgagctgataagaaacatgagtcagctcatggaaaccggagaggtcagcgatgatcttgcgtcccagctgatatatcagctggtggccgaattagccaaggcacagccaacacacatgcagtggcggggcatccaggaagagacacctcctgctgctcagctcagaggggaaacagggagtgtgtcccaaagctcgcatgcaaaaaactcaggcaagctgacattcaagccgaaaggacctgttctcatgaggcaaagccaacctccctcaatttcatttaataaaacaataaattccaggattggaaatacagtatacattacaaaaaggacagaggtcatcaatatactgtgtgaccttattacccccagtgaggccacatatacatggaccaaggatggaaccttgttacagccctcagtaaaaataattttggatggaactgggaagatacagatacagaatcctacaaggaaagaacaaggcatatatgaatgttctgtagctaatcatcttggttcagatgtggaaagttcttctgtgctgtatgcagaggcacctgtcatcttgtctgttgaaagaaatatcaccaaaccagagcacaaccatctgtctgttgtggttggaggcatcgtggaggcagcccttggagcaaacgtgacaatccgatgtcctgtaaaaggtgtccctcagcctaatataacttggttgaagagaggaggatctctgagtggcaatgtttccttgcttttcaatggatccctgttgttgcagaatgtttcccttgaaaatgaaggaacctacgtctgcatagccaccaatgctcttggaaaggcagtggcaacatctgtactccacttgctggaacgaagatggccagagagtagaatcgtatttctgcaaggacataaaaagtacattctccaggcaaccaacactagaaccaacagcaatgacccaacaggagaacccccgcctcaagagcctttttgggagcctggtaactggtcacattgttctgccacctgtggtcatttgggagcccgcattcagagaccccagtgtgtgatggccaatgggcaggaagtgagtgaggccctgtgtgatcacctccagaagccactggctgggtttgagccctgtaacatccgggactgcccagcgaggtggttcacaagtgtgtggtcacagtgctctgtgtcttgcggtgaaggataccacagtcggcaggtgacgtgcaagcggacaaaagccaatggaactgtgcaggtggtgtctccaagagcatgtgcccctaaagaccggcctctgggaagaaaaccatgttttggtcatccatgtgttcagtgggaaccagggaaccggtgtcctggacgttgcatgggccgtgctgtgaggatgcagcagcgtcacacagcttgtcaacacaacagctctgactccaactgtgatgacagaaagagacccaccttaagaaggaactgcacatcaggggcctgtgatgtgtgttggcacacaggcccttggaagccctgtacagcagcctgtggcaggggtttccagtctcggaaagtcgactgtatccacacaaggagttgcaaacctgtggccaagagacactgtgtacagaaaaagaaaccaatttcctggcggcactgtcttgggccctcctgtgatagtacgtacacctcccagaccgctacaaacaaaggtgctgccagtcatgtcaagagggataaacctttggaggggtcatgatgctgctgtgaagataaaagtagaatataaaagctcttttccccatgtcgctgattcaaaaacatgtatttcttaaaagactagattctatggatcaaacagaggttgatgcaaaaacaccactgttaaggtgtaaagtgaaattttccaatggtagttttatattccaattttttaaaatgatgtattcaaggatgaacaaaatactatagcatgcatgccactgcacttgggacctcatcatgtcagttgaatcgagaaatcaccaagattatgagtgcatcctcacgtgctgcctctttcctgtgatatgtagactagcacagagtggtacatcctaaaaacttgggaaacacagcaacccatgacttcctcttctctcaagttgcaggttttcaacagttttataaggtatttgcattttagaagctctggccagtagttgttaagatgttggcattaatggcattttcatagatccttggtttagtctgtgaaaaagaaaccatctctctggataggctgtcacactgactgacctaagggttcatggaagcatggcatcttgtccttgcttttagaacacccatggaagaaaacacagagtagatattgctgtcatttatacaactacagaaatttatctatgacctaatgaggcatctcggaagtcaaagaagagggaaagttaaccttttctactgatttcgtagtatattcagagctttcttttaagagctgtgaatgaaactttttctaagcactattctattgcacacaaacagaaaaccaaagccttattagacctaatttatgcataaagtagtattcctgagaactttattttggaaaatttataagaaagtaatccaaataagaaacacgatagttgaaaataatttttatagtaaataattgttttgggctgatttttcagtaaatccaaagtgacttaggttagaagttacactaaggaccaggggttggaatcagaatttagtttaagatttgaggaaaagggtaagggttagtttcagttttaggattagagctagaattgggttaggtgagaaagaaagttaaggttaaggctagagttgtctttaagggttagggttaggaccaggttaggtcagggttggattgggtttagattggggccagtgctggtgttagtgatagtgtcaggatggaggttaggtttggagtaagcgttgttgctgaagtgagttcaggctagcattaaattgtaagttctgaagctgatttggttatggggtctttcccctgtatactaccagttgtgtctttagatggcacacaagtccaaataagtggtcatacttctttattcagggtctcagctgcctgtacacctgctgcctacatcttcttggcaacaaagttacctgccacaggctctgctgagcctagttcctggtcagtaataactgaacagtgcattttggctttggatgtgtctgtggacaagcttgctgagtttctctaccatattctgagcacacggtctcttttgttctaacttcagcttcactgacactgggttgagcactactgtatgtggagggtttggtgattggg

SEQ ID NO: 472 - DNA, 2468 bp, Homo sapiens
  ENST00000569510
atttaacttcgcggcggcggcggcgactgcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggctacaactgagacccggaggagactagaccccatggcttcctggacgagcccctggtgggtgctgatagggatggtcttcatgcactctcccctcccgcagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctgaaaaaagagaagaaaatgtaattgctgttcctttgggaagtcgaagtgtgagaattacagtgaaaggacctgcccacctctcctccgctgctgatacccaggcaaacagggtctggagtggacctccagcaaactccaacagacctgcagctgagcgtcctgacttgtagaaggaaaactaacaaacagaaaggacatccacaccaaaaccccatctgtacgtcaccatcatcaaagaccaaaggtagataaaaccacaaagatggggaaaaaacaggagaaaaactggaaactctaaaaatcagagcacctctcctcctccaaaggaacacagctcctcaccagcaacggaacaaagctggatggagaatgactttgacgagttgagagaagaaggcttcagacaatcaaactactccgagctaaaggaggaagtccgaacccatggcaaagaagttaaaaaccttgaaaacaaattagacgaatggctaactagaataaccaatgcagagaagtccttaaagaacctgatggagctgaaaaccaaggcacgagaacgtgacgaatgcacaagcctcagtagccaattcgatcaactggaagaaagggtgtccgtgatggaagatcaaatgaatgaaatgaagcgaaaagagaagtttagagaaaaaaagaataaaaagaaatggacaaagcatccaagaaatatgggactatgtgaaaagaccaaatctacgtctgattggtgtacctgaaagtgacggggagaatggaaccaagttggaaaacactctgcagggtattatccaggtgaacttccccaatctagcaaggcaggccaacattcaaattcaggaaatacagagaatgccacaaagatactcctcgagaagagcaactgcaacacacataattgtcagattcaccaaagttgaaatgaaggaaaaattgttaagggcagccagagagaaaggtcgggttacccacaaagggaagcccatcaggctaacagcagatctcttggcagaaactctacaagccagaagagagtgggggccaatattcaaaattcttaaagaaaagaattttcaacctagaatttcatatccagccaaactaagcttcataagtgaaggagaaataaaatcctttacagataagcaaatgctgagagattttgtcaccaccaggcctgccctaaaagagctcctgaaggaagagctcaacatgcaaaggaacaactggtaccagccactgcaaaaacatgccaaattgtaaataccattgatgctaggaagaaactgcatcaactaatgggcaaaataaccagctaacatcataatgacaggatcaaattcacacataacaatattaaccttaaatgtaaatgggctaaataccccacttaaaagacacagactggcaaattggataaagagtcaagacctatcagtgtgctgtattcaggaaacccatctcacgtgcagagacacacataggctcaaaataaagggatggaggaagacctaccaagc

SEQ ID NO: 473 - DNA, 4986 bp, Homo sapiens
  ENST00000561483
atttaacttcgcggcggcggcggcgactgcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggctacaactgagacccggaggagactagaccccatggcttcctggacgagcccctggtgggtgctgatagggatggtcttcatgcactctcccctcccgcagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctgaaaaaagagaagaaaatgtaattgctgttcctttgggaagtcgaagtgtgagaattacagtgaaaggacctgcccacctctttattgaatcaaaaacacttcaaggaagcaaaggagaacacagctttaacagccccggcgtctttctcgtagaaaacacaacagtggaatttcagaggggctccgagaggcaaacttttaagattccaggacctctgatggctgatttcatcttcaagaccaggtacactgcagccaaagacagcgtggttcagttcttcttttaccagcccatcagtcatcagtggagacaaactgacttctttccctgcactgtgacgtgtggaggaggttatcagctcaattctgctgaatgtgtggatatccgcttgaagagggtagttcctgaccattattgtcactactaccctgaaaatgtaaaaccaaaaccaaaactgaaggaatgcagcatggatccctgcccatcaagtgatggatttaaagagataatgccctatgaccacttccaacctcttcctcgctgggaacataatccttggactgcatgttccgtgtcctgtggaggagggattcagagacggagctttgtgtgtgtagaggaatccatgcatggagagatattgcaggtggaagaatggaagtgcatgtacgcacccaaacccaaggttatgcaaacttgtaatctgtttgattgccccaagtggattgccatggagtggtctcagtgcacagtgacttgtggccgagggttacggtaccgggttgttctgtgtattaaccaccgcggagagcatgttgggggctgcaatccacaactgaagttacacatcaaagaagaatgtgtcattcccatcccgtgttataaaccaaaagaaaaaagtccagtggaagcaaaattgccttggctgaaacaagcacaagaactagaagagaccagaatagcaacagaagaaccaacgttcattccagaaccctggtcagcctgcagtaccacgtgtgggccgggtgtgcaggtccgtgaggtgaagtgccgtgtgctcctcacattcacgcagactgagactgagctgcccgaggaagagtgtgaaggccccaagctgcccaccgaacggccctgcctcctggaagcatgtgatgagagcccggcctcccgagagctagacatccctctccctgaggacagtgagacgacttacgactgggagtacgctgggttcaccccttgcacagcaacatgcgtgggaggccatcaagaagccatagcagtgtgcttacatatccagacccagcagacagtcaatgacagcttgtgtgatatggtccaccgtcctccagccatgagccaggcctgtaacacagagccctgtccccccaggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaagtgttctgtcagttgtggtgttggaatccagagaagaaagcaggtgtgtcaaaggctggcagccaaaggtcggcgcatccccctcagtgagatgatgtgcagggatctaccagggctccctcttgtaagatcttgccagatgcctgagtgcagtaaaatcaaatcagagatgaagacaaaacttggtgagcagggtccgcagatcctcagtgtccagagagtctacattcagacaagggaagagaagcgtattaacctgaccattggtagcagagcctatttgctgcccaacacatccgtgattattaagtgccccgtgcgacgattccagaaatctctgatccagtgggagaaggatggccgttgcctgcagaactccaaacggcttggcatcaccaagtcaggctcactaaaaatccatggtcttgctgcccccgacatcggcgtgtaccggtgcattgcaggctctgcacaggaaacagttgtgctcaagctcattggtactgacaaccggctcatcgcacgcccagccctcagggagcctatgagggaatatcctgggatggaccacagcgaagccaatagtttgggagtcacatggcacaaaatgaggcaaatgtggaataacaaaaatgacctttatctggatgatgaccacattagtaaccagcctttcttgagagctctgttaggccactgcagcaattctgcaggaagcaccaactcctgggagttgaagaataagcagtttgaagcagcagttaaacaaggagcatatagcatggatacagcccagtttgatgagctgataagaaacatgagtcagctcatggaaaccggagaggtcagcgatgatcttgcgtcccagctgatatatcagctggtggccgaattagccaaggcacagccaacacacatgcagtggcggggcatccaggaagagacacctcctgctgctcagctcagaggggaaacagggagtgtgtcccaaagctcgcatgcaaaaaactcaggcaagctgacattcaagccgaaaggacctgttctcatgaggcaaagccaacctccctcaatttcatttaataaaacaataaattccaggattggaaatacagtatacattacaaaaaggacagaggtcatcaatatactgtgtgaccttattacccccagtgaggccacatatacatggaccaaggatggaaccttgttacagccctcagtaaaaataattttggatggaactgggaagatacagatacagaatcctacaaggaaagaacaaggcatatatgaatgttctgtagctaatcatcttggttcagatgtggaaagttcttctgtgctgtatgcagaggcacctgtcatcttgtctgttgaaagaaatatcaccaaaccagagcacaaccatctgtctgttgtggttggaggcatcgtggaggcagcccttggagcaaacgtgacaatccgatgtcctgtaaaaggtgtccctcagcctaatataacttggttgaagagaggaggatctctgagtggcaatgtttccttgcttttcaatggatccctgttgttgcagaatgtttcccttgaaaatgaaggaacctacgtctgcatagccaccaatgctcttggaaaggcagtggcaacatctgtactccacttgctggaacgaagatggccagagagtagaatcgtatttctgcaaggacataaaaagtacattctccaggcaaccaacactagaaccaacagcaatgacccaacaggagaacccccgcctcaagagcctttttgggagcctggtaactggtcacattgttctgccacctgtggtcatttgggagcccgcattcagagaccccagtgtgtgatggccaatgggcaggaagtgagtgaggccctgtgtgatcacctccagaagccactggctgggtttgagccctgtaacatccgggactgcccagcgaggtggttcacaagtgtgtggtcacagtgctctgtgtcttgcggtgaaggataccacagtcggcaggtgacgtgcaagcggacaaaagccaatggaactgtgcaggtggtgtctccaagagcatgtgcccctaaagaccggcctctgggaagaaaaccatgttttggtcatccatgtgttcagtgggaaccagggaaccgggtaaagctaacacatctagtttgtggacagcactatctgtccacacagatagtgtgataataatcaccttgtttccaataaactacttttggggcggggggcaggaatctgactg

SEQ ID NO: 474 - DNA, 543 bp, Homo sapiens
  ENST00000565653
gtgctttggtgggaacggaacggtgtcacccctcaccgagtggctagaccaggaggagggggaggctggcggagagtgagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcac

SEQ ID NO: 475 - DNA, 533 bp, Homo sapiens
  ENST00000567663
caaacttttaagattccaggacctctgatggctgatttcatcttcaaggttatcagctcaattctgctgaatgtgtggatatccgcttgaagagggtagttcctgaccattattgtcactactaccctgaaaatgtaaaaccaaaaccaaaactgaaggaatgcagcatggatccctgcccatcaagtacctgctgacttggattgcctggggaagtttcctggcttactacaataccttaaaataacagaacaatatcaagtcccagaatcctccagatatctgccagctggcttaggaagaagtgtgcaagtggaaaaggaagcgttctcagtggatttcatttcctgttactgaactgcacatttcctgtaagcctggttgaacataattattaatagagacctttcaaaggacaaattctgtgaaataaagtggttttctgaagagcctactaataggacagtgtgttaatatcactaatatattaagagagtaatgattataaaaaggaataaatttattgaaattgc

SEQ ID NO: 476 - DNA, 551 bp, Homo sapiens
  ENST00000562296
agtgtggcccaaggactagtcaaattgacatcagcagggaacttataagaaatgaggaatctcaagtcccacccagacctaaggaatcagagtctgcatttcaacaagatccctgggtgttgtaatgatacacttgcagtgtgagaagtgtttccttacctgcctctcattcttgtttggtgttctgtcagttgtggtgttggaatccagagaagaaagcaggtgtgtcaaaggctggcagccaaaggtcggcgcatccccctcagtgagatgatgtgcagggatctaccagggctccctcttgtaagatcttgccagatgcctgagtgcagtaaaatcaaatcagagatgaagacaaaacttggtgagcagggtccgcagatcctcagtgtccagagagtctacattcagacaagggaagagaagcgtattaacctgaccattggtagcagagcctatttgctgcccaacacatccgtgattattaagtgccccgtgcgacgattccagaaatctctgatccagtgggagaaggatggccgttgcctgca

SEQ ID NO: 477 - DNA, 575 bp, Homo sapiens
  ENST00000567716
aaattgacatcagcagggaacttataagaaatgaggaatctcaagtcccacccagacctaaggaatcagagtctgcatttcaacaagatccctgggtgttgtaatgatacacttgcagtgtgagaagtgtttccttacctgcctctcattcttgtttgggagcattcaatgcaagaggacaatggagcaggatctacacaattctaaagaaaagcaagcatgactcaaggatttcctcttcatcctgtgttcttcatgtagagagacagcagagaggcagtcagagaatactgtctgataagcccttgaaaaagctgtagggccaagatgagatacagagatgactcaaaacagagaatccaggaatgcatagatcctggtaaaaaagtgttctgtcagttgtggtgttggaatccagagaagaaagcaggtgtgtcaaaggctggcagccaaaggtcggcgcatccccctcagtgagatgatgtgcagggatctaccagggctccctcttgtaagatcttgccagatgcctgagtgcagtaaaatcaaatcagagatgaagacaaaacttggtg

SEQ ID NO: 478 - DNA, 2908 bp, Homo sapiens
  ENST00000369041
aggggccccagtggccgccgcggagcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaaggtgagcccggaacccccagccatatcctgcatcctgggtaaccacgcccaggacacctcagcctttccagcatagctcaataaacttgtattgatcaag

SEQ ID NO: 479 - DNA, 1826 bp, Homo sapiens
  ENST00000483335
gccgccgcggagcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcaggtgggtgcccttgatccagctcagcccgatggcagaagaggttgacaaaaaagaaagacacctgttggggtggcctgccagacccaggagtggagggctctgagggcccgggaattcggactcaggacagggattctccatggctaggcccagaaacacagggtccaaccactctccagcagggagacctgggggtgaaggggtgagccctgcgcaggtctctgttccttggtcttcactgggcagtgtggagaggtgtggccaggaggagcccgcgtttgtccagaccagggtctactctggcaccagagtgaccacctctgacctctcctttcctcgtcctgggccgggaacgacaccaaatgagggacatggaaagggctggagtaacaagagtcaggcagagcctgaagacttgggtggaacatgggcccttctctggagatcctggcctcccccgttcagtcagggtggagttgctgaccttagtggccggcccagccaggggaaggagtggccatcggcaacccccaccccaaccccaatccctgaggcgcccgctctggctcagccactctgacccctccctcaaattccgaaccctaggtctcagggagggcagtggggctgagtgtctgcccccaggcacattcctacccttctcttggtcattttctgccccagagctggcccacctcagcaatgcgagggctccctggattcctctcccgggtgcctttcagatccaacagaaacagattttttttttcctggaaagcagaactaagagtgggatgaggagcaggggtgggaaggactcaaagtgagaagaagggggcaaagagagtcaggcttggtggctggggtggcttccaagcctcacttctccagtgttcaaagctgaacttcagatggacttcccggctcttcagaatgagaggcctgtggctggggcatgaggcagccccggctgcacctctccttcccgcttccccagctggtagagacgcacaggaaacaagccctcactgaaccaactccagatgctggcacccagagtgggtgttacattgccggcttcttctctagagattaaaccgtcaacccatttagcttatcccttggccaaaaagtgtatgagatgtgcctggatgttccctaaagagcttatctaagaagggaagagaaagccgggaggcaagtaggacagagagatgactggggaaggtcttgtgtctggaagacccaaggaaggggcttctggtgggtcctcagagagagtgtctggcgcatcctcagtggagccttcctcctctactttctaggcacctctgggagggcaggagtgggagcagatgacaaccattttagaaggagccctctggctgggtgcggtggctcacacctgtcatcccagcactttgggaggccaaggcaggagaagcgcttgaggcctggagttcaagaccagcctgtgcaatttagctggatcccatctccaccaaaaaataccaaaattagctgggtgtggtggtgcacgcatgtagtcccacctactcaggaggctgaggaaggagagcctgtgagtttgaggctgcaatgagctttggtggcaccactgccctccagcctggatgacagagtgagatctccatctcaaaaaaaaaaaaaaa

SEQ ID NO: 480 - DNA, 4167 bp, Homo sapiens
  ENST00000369038
gaggatcctaaagggatggaccagtttcaccccctcctccatattctctgagctgtcctcccagccccaagctctctggacactggagaggtaaccaccaggcttctgtccctgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacaaatgagaaa

SEQ ID NO: 481 - DNA, 1803 bp, Homo sapiens
  ENST00000489159
cagggtttcatatggacccccaatatagaagtcagataagggactgaaccagggactgggggcccagggccctagggctcagcctcctcctcagcccacgaagccatgtgactgctgggctggggatcgaaggcagagcctggttctgaagcctagagctggaagctggctgagaaggtctgggaagcccagctccctggattcccctcgccccctcagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacaaatgagaaa

SEQ ID NO: 482 - DNA, 4319 bp, Homo sapiens
  ENST00000369039
ggagttgcggccgaggcggccgtgaccggagcgcggctcaggggccccagtggccgccgcggagcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagcccctctgcttcccctgcgccatgccttctttcttctccctggggctgggtcaggagacagcacaggtgtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacaaatg

SEQ ID NO: 483 - DNA, 4250 bp, Homo sapiens
  ENST00000271643
ggagttgcggccgaggcggccgtgaccggagcgcggctcaggggccccagtggccgccgcggagcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacaaatg

SEQ ID NO: 484 - DNA, 587 bp, Homo sapiens
  ENST00000462214
ccgtgtccagccagggtcctgggccgcgacctggttctcccggagtctacaagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagatgaaattgaaatggccaatgagcacaccctcattcatccagcgagcattgaggaccccctagaggccaggcccatgagtgatgaagatcccgaggatgaagacgccttgccagccagctttgctgtgctctgagcatgactaaactaaaagtaatgaatccagaccttgaagactggtgtgtgtgtaaaaggcaagaagtgagaagattcacgtgtagatccaggacaatctgaatttacttctgttcagtagttcccaaaggctttttctacatggagggactcggagtgacacagcagctccctcttgtgggcagattcccctgtgtaaggtgctggaggctgaggttccagcctgcagcc

SEQ ID NO: 485 - DNA, 2523 bp, Homo sapiens
  ENST00000460734
gcggcggggctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagcataattgatatactgtggttactctacctatttgtgtaggcctctcaggtcattgaaacaagatgttgtacaaattagcagatgacactggcgcatggaggaatgagtctagtgttggtaatgagaagttggatatccgtttgatccttgttctactgcaggtagtgtatattttgagaacagcgtgaggtttattctactaatggaaatttacaaaaataccagtttgaatgattgagaaatctaagttaaagaacccttgaatagaaatgtcgctgttcagtgcgttgatcgattctcacatctgaagccagctgtgtattcttgagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaaggaagctgtcagtgtggtgttgggcctgattgattcgcatcagctcaggtggcgtcctattggaaggtcggcagtgggagagcagctggccagttcctcccgcctgcaaggcaggggagtgtacaaggtgtgtaccccaggggcaggatgctaacactgcactgactgagaaaagaatttgtcttacctgtacctgacaggtgtgtacctgaaagagatgaaattgaaatggccaatgagcacaccctcattcatccagcgagcattgaggaccccctagaggccaggcccatgagtgatgaagatcccgaggatgaagacgccttgccagccaggtggaagaaagaaatgggaagaaaaaggaagagaaccatagctacgttgtgagggcattgcttcaactctggtaacttcatgtgaaatgactacaaaatgaattaatatgcagtaagagagccagtgccccaccagggcacctttccacttgctggcacacagatttaccacaattaggatactgcttgtcctgtcatgccgggagagtctaaattactctgactttcaagaaaccaaaaatatgcatttttgatgttaggaagatttactgtgcattgggctgtgtcatttgatgaggaaaaaaccaaatgatctctttatgaaaatgaagaattgtagcctgtggaggtgaccaaggaaccagatcccaagaggcctctgccactgaaaggagatttttattacttgcgtttcctagacgggggggcactcgcgccaagcaggcccacggggcacactggtgtcagtcaaggggcagaaaggagccacaggaaagcccaggacagagcctgagtggggtttctgtgggaaaggcagggcagggcacccgtgtaggaatggctagtgtgaacagttccagtgggccctgggctgtaggagagatcactagctgcctgctaccaggccctggggtgatttcgggcaggcgggcagttagataagggaggtgggtagagccgaccacctgcctggaaccctgtgctggctataagccctgggagggccagtctctccctgtgtctgtaaggcccacaaatgccaaagcattaggaataagaaaatggacgtaatagaattgatcctgtgaggactggatgcctaactgccacatacagaatgtgagaaagcacagaacaactgccttcattgacaagatggtgcccagagctcaagacaggcacacagcaggaggatgccggcaggatccctcaacaagcttaccgtggtatctttcacaatgttaactgtcatcccagatgaacttttaatgacagtgtatctctgaagattgtgcttttagcgtattttcacttaaagtcatatctcatttagtagacctgccagattcctgaaaagttacacacaagccagctgacatgacctttgccagtcatgttgaccacgttctcaccgagctgtggactcctcactaggagcctttacctacggccagatggctgttgtcactgcctgtggtggggttacggtttcggactcacctgatccgttctgccgggattacctacggccagatggctgttgtcactgcctgtggtggggttatggtttcggacttacctgatccgttctgccgggattacctacggccagatggctgttgtcactgcctgtggtggggttatggtttcggacgcacctgatccgttctgccgggattttaaagtatgggagtttaggcatactttgcaagttgtttcttgaatatacttttctgaattatg

SEQ ID NO: 486 - DNA, 5031 bp, Homo sapiens
  ENST00000389861
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagatgaaattgaaatggccaatgagcacaccctcattcatccagcgagcattgaggaccccctagaggccaggcccatgagtgatgaagatcccgaggatgaagacgccttgccagccagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 487 - DNA, 4913 bp, Homo sapiens
  ENST00000492414
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 488 - DNA, 5033 bp, Homo sapiens
  ENST00000496664
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 489 - DNA, 3563 bp, Homo sapiens
  ENST00000389863
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 490 - DNA, 6882 bp, Homo sapiens
  ENST00000348831
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtgggtctcctggggccatggggagagattggtgcagaccttaccccacagcatacacctgccacagcgaaatccagggtgttggcacctgtgtgtccgtgatgagcctaggaaaccagagcaggggcagaggggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctagaacatctgccccacagcagcctcctcctccaccgaagagggtagttgtctccctgaagcagtcacagcaggcgtctctgccgctccgtcaccacagtggggttttgttcaggcagatcgcgctggggttctgcacctgcagaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaactacccggtatgtctggcttttcccttctgtcaggtaatagctaaagtcagcatgattgctccctgtaccaccccaaataagtgagtgcctcaccttgtggggcctgagcagctaccttgagaccatgtgaggtggcacctttccggggtggactcgtgcggccttgaggacaggcacagggcaccctatcccaagccgtccaggcaggaggaaggcagccaaggcaactgggttctgggagccctgggtggggcagctgtggggaggaactgggttcggggagccctgggcggggcggctgttggggggaactgggttcggggtgccctgggcagggggctactggggggcggctgtgaggaggagttgggttcagggagccctgggcggggtggctgtcagggggaactgggttccgggagccctgggccggggcagggggcggctgtaggaaggaactggtttcggggagccctgggcggggcggctgtggggaggaaggtgacgtgcaggggaccagaggctctgcactgctcctaggacagctcatctgtaatcagaaaaaaaataaacaaaatacagaacgctgactcctccgtgagacagatcggggaccttagcactttaatccctcccttctgagcgctcggtgtgcacttttagactatagctgtttcattgacgtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgacaggtccagatggatgtcgtcaccaccttcctcagctctcatcacctggtcgtacgccaggcccacctcttcccagcaagggacgccaaagaactgcagtttttattctgagtcttaatttaacttttcatcatcttttcctattttggagaattttttgtaattaaaagcaattattttaaaatgtgcaagccagtatctcacaaggcatggatttctgtggaatttatttttattcaaataaccatatttatctccaggctgtggaatcgccactttctttgtgaagacagtgtctctccttgtaatctcacacaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 491 - DNA, 704 bp, Homo sapiens
  ENST00000449478
aaatgtcgctgttcagtgcgttgatcgattctcacatctgaagccagctgtgtattcttgagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtcttt

SEQ ID NO: 492 - DNA, 389 bp, Homo sapiens
  ENST00000464215
cacactggccaagcgcggagttctgcttacttcagtcctgctgagatactctctcagtccgctcgcaccgaaggaagctgccttgggatcagagcagacataaagctagaaaaatttcaagatgaaattgaaatggccaatgagcacaccctcattcatccagcgagcattgaggaccccctagaggccaggcccatgagtgatgaagatcccgaggatgaagacgccttgccagccagacagaaacagtctccgccagtcaagaaaccctcaaaagtattttgccatggatatagaagatgaagaaaacatgagtaagatctaggcctatcacgtagtatcagatagctaattttatgttaacattttggtgtttttgcaaatgtatt

SEQ ID NO: 493 - DNA, 6604 bp, Homo sapiens
  ENST00000360697
caaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtgggtctcctggggccatggggagagattggtgcagaccttaccccacagcatacacctgccacagcgaaatccagggtgttggcacctgtgtgtccgtgatgagcctaggaaaccagagcaggggcagaggggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctagaacatctgccccacagcagcctcctcctccaccgaagagggtagttgtctccctgaagcagtcacagcaggcgtctctgccgctccgtcaccacagtggggttttgttcaggcagatcgcgctggggttctgcacctgcagaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaactacccggtatgtctggcttttcccttctgtcaggtaatagctaaagtcagcatgattgctccctgtaccaccccaaataagtgagtgcctcaccttgtggggcctgagcagctaccttgagaccatgtgaggtggcacctttccggggtggactcgtgcggccttgaggacaggcacagggcaccctatcccaagccgtccaggcaggaggaaggcagccaaggcaactgggttctgggagccctgggtggggcagctgtggggaggaactgggttcggggagccctgggcggggcggctgttggggggaactgggttcggggtgccctgggcagggggctactggggggcggctgtgaggaggagttgggttcagggagccctgggcggggtggctgtcagggggaactgggttccgggagccctgggccggggcagggggcggctgtaggaaggaactggtttcggggagccctgggcggggcggctgtggggaggaaggtgacgtgcaggggaccagaggctctgcactgctcctaggacagctcatctgtaatcagaaaaaaaataaacaaaatacagaacgctgactcctccgtgagacagatcggggaccttagcactttaatccctcccttctgagcgctcggtgtgcacttttagactatagctgtttcattgacgtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgacaggtccagatggatgtcgtcaccaccttcctcagctctcatcacctggtcgtacgccaggcccacctcttcccagcaagggacgccaaagaactgcagtttttattctgagtcttaatttaacttttcatcatcttttcctattttggagaattttttgtaattaaaagcaattattttaaaatgtgcaagccagtatctcacaaggcatggatttctgtggaatttatttttattcaaataaccatatttatctccaggctgtggaatcgccactttctttgtgaagacagtgtctctccttgtaatctcacacaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 494 - DNA, 736 bp, Homo sapiens
  ENST00000481022
gtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggtctcatccaagaatctcacattcaagataagtgacaccagcccgtcagcagctgaaaacccaagtctgggtcaagatggcagcctctgggctcccacatgactggctggtggctgtttgctgttcctaagccgaggagcccatcaaagcagcgaatgagccagcacagcagtgagcacctatcagagcgcagggagggaggggcctccaacaactgttctagggcctgccagttgcctgggagtctctactttgaatttcctacatgggctgtatgaggacttccccgcatgcccaggctggaggtggacagccacccttccatttgacctccccagcgcagtgaaatcaggatgaaggaaggggaagttccagggtgggcttagattggcttacgtgaaagagaaaaagtaaaggagaaaatcacctttagttctcatctctaaatcctaaaactctctgattatgtattccttctttt

SEQ ID NO: 495 - DNA, 301 bp, Homo sapiens
  ENST00000631642
tgacaacaggtgaacaccacaacgactgaatagaatagttccctaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgt

SEQ ID NO: 496 - DNA, 5032 bp, Homo sapiens
  ENST00000437626
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcact

SEQ ID NO: 497 - DNA, 159 bp, Homo sapiens
  ENST00000611195
atggccaatgagcacaccctcattcatccagcgagcattgaggaccccctagaggccaggcccatgagtgatgaagatcccgaggatgaagacgccttgccagccaggtggaagaaagaaatgggaagaaaaaggaagagaaccatagctacgttgtga

SEQ ID NO: 498 - DNA, 4583 bp, Homo sapiens
  ENST00000629643
atgaagatcccgaggatgaagacgccttgccagccagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcact

SEQ ID NO: 499 - DNA, 8421 bp, Homo sapiens
  ENST00000381312
tgcgctgggagcccagagcaggaggcagagcccgcgggaagctcggagcactcaggacgccgcgcgcccttccccgccctccctgaccagggagcagctcgctccaggcgcccagccgaggcccccagcccagtgggagcaagtcatagagaacaattcgagagacagagagacggagcgcgctttcctgctcagtcctgaaaagtgagccgctcccgggtttgcaacctcaagcttcgcagcagcggcggcggcggctgccgggaaggaggcaggtgcaggtgcaggagggaggcggctctgggctccgcgcctgggtctcggccatggcctcggtcctggggagcggcagagggtctggagggctgagcagtcaactcaaatgcaagtccaagaggaggaggaggcggaggtccaagcggaaagataaagtaagcatattgtcaaccttcctcgctcctttcaagcacctgagtcctggcatcacaaacacggaggatgacgacaccctcagtaccagcagcgcggaggtgaaggagaaccgcaacgtgggcaacctggccgcgcggccaccgccctccggggaccgggcccggggcggcgcgcccggcgcgaagaggaagcggccgctggaggaggggaatgggggccacttgtgcaaactgcagctggtctggaagaagctgtcgtggtcggtggcgcccaagaacgcgctggtgcagctgcacgagctgaggccgggcctgcagtaccggacagtgtcgcagacgggcccggtgcatgccccggtcttcgcggtagcggtggaggtgaacgggctcacgttcgagggcacaggccccaccaagaagaaggccaagatgcgcgcggcggagctggcactcaggtccttcgtgcagttccccaacgcctgccaggcgcacctggccatgggcgggggcccgggccccggcacggacttcacctccgaccaggccgatttccccgacacgctcttccaggagttcgagcccccggcgccgcgccccggactcgcgggaggccgccccggggacgccgcgcttctgtccgcggcctacgggcgacggcggctgctgtgccgcgcgctggacctggtgggcccgacccccgccacccccgcggccccgggcgagcgcaaccccgtggtgctgctgaaccgcctgcgcgccgggctgcgctacgtgtgtctggcagaaccggccgagcggcgcgcgcggagcttcgtgatggccgtgagcgtggacggcaggacgttcgagggctcggggcgcagcaagaagctggcccggggtcaggccgcgcaggccgcactgcaggagctgttcgacatccagatgcccggccacgcgcccggcagggccaggaggacgccaatgccgcaggaattcgcagactccatatcccagctggtcacacagaagttccgcgaggtgacgacggacctcacgcccatgcacgcccgccataaagcgctggcaggaatcgtcatgaccaaaggcctggatgctcggcaggcgcaggtcgtggccctgtcctcggggaccaagtgcatcagcggcgagcacctcagtgaccaggggctggtggtgaatgactgccacgcggaggtcgtggcccggcgggcgttcctgcacttcctctacacgcagctggagctgcacctgagcaagcggcgcgaggactcagagcgatcgatattcgtgcggttaaaagaaggtggctaccggctgcgagagaacatcctcttccatctctacgtgagcacctccccctgtggagacgcaagactccactctccctacgagatcaccacagacctgcacagcagcaaacacctcgtcaggaagttccgcgggcacctgcgcaccaagatcgagtccggggaagggacggtccccgtgcgtggccccagcgcagtgcagacctgggacggcgtcctgctgggggagcagctgatcaccatgtcctgcacggacaagatcgccaggtggaacgtcctggggctgcagggcgcgctcctgtcccacttcgtggagcccgtgtacctgcagagcatcgtggtgggcagcctgcaccacacgggccacctcgcacgcgtcatgagccaccgcatggagggtgtcggccagctgcccgcctcctaccggcacaaccggcctctcctcagcggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggagggatgggaccgtgtctggggggcgacgtggcgggtcggccggttccctgcattcgttttactttggtgtcccagaaacacgcgagtgtgcaatgtttggacgagcaacaacacaaattcagaacgtgcctctttccagatcgctggccccagaaccctgtcccccacacccaggggcacatgcactgttgagttagcgccgactcttcctgtggagtctgagggaggggctccattcaggcaaaggggttttagctgcagccttggaaggaggcaccgacacgacaccaggcaggagtgagcctcaggccccgtccctgcaccccacccctgcgtgcgcctcttggtgatgctggggtctcactagcttgagggggcacatgaagataagccacaaatgaagagaaaagccatgcccaccccagccccagagaaaccaataagaatcctctattattttcactattcatttaggtttttatactccacctcctttcaaaaaagatttaagatgtacgacattaccgaacacctaaaatagaaccagagaaacgaaagccattcccacaaagtgaaggaacagtttccaaaacccctgcgaggcagagttaagacctgtgacgtggggagcctggaaacacccggcccacgcgtgctgcagatgtggggagcctggaaacacccggcccacgcgtgctgcagatgtggggagcctggaaacacccggcccacgcgtgctgcagatgtggggagtctggaaacacccggcccacgcgtgctgcagatgtggggagcccggaaacacctggcccatgcctgttcagtccgtcatggcgtttggtttatggtggccgatactaagagccactgaggtctgggttgtgtaagggttagctaccaccctataacctccctaccaggtaataaggagaccaagtctttgatcaaattctgattttttaactaaattttcattagaaagcaagcacaaaataaaatcaaaacaacctttaccttcagcttgagaggctaccagctctctattctttcagattctccaatcaacaccttgcaggacaagaccccaaaaaagttcagctgtcaaaaaatgtaagaggcaggattctgtgaccctcagagcaggcttccaacaccagagaccttcagctcacagtggagatgggacatgggggctttagcccacagcatcatccctgagagccaaggcgctgtattcatacggggtcaggctcttttccaagtatctttacgtaatccatgtacctcgagctgctgtcatctcacctccgagaactcatttctaacattcatcatgctagatagccagtctctcatttctccaacttaaaaaatccatctctgaaattcatgacagtgatggcagacggcaaagcatggtggtgtccacctctggggtgtgggcttcccggaaagaatcccagctgaccaccccagaaagtgcaagaataacattgtgctgtacatagtcaagtgctataaattacagttatcataatgagaaggcagaaatgaaactgagttgtagctatttgttacaagataataagaagtagagatattagtatggaaaaagaaacttttcctgggatttaaaatcaggccaaatttatcactcgagttcttttagaaaagaaaacaggtactggagtagacaacttcttccagataaagtttcaaaagatacgagaacattttttcaaataaaggactcacattaatcttttataaaaatcacaaaaataaatgaaatcttaattcagtgcaaaagctaagctcaaacgaccagtttctattaagttctggtaacttgacatcactaggatgaagcttagagaacttagagtcgagaggtgatgggtggctcagacattcgcagcagtcagaagtgagcgctcccctgaatgcgtgggagcacggccagctcctggctgaagtctcccacccaggcctcaaatcaccttcatctgagatgttggctagagaagcatataatgctttgtcccagtgggctccaaatcacgctgtttctgcagcgagggggcctgtgttgtaagcagatttcactgtcacagggaagacgcagggtctgattcacgggactcggaaagcgctcggccacccagtggccagcatcatgaagccacagctggggggttgggattcgttttgtctcaggcattgaccttccagaaacaactcagactttactgaaatatcaacatccacatctggagaaagccacacattaattccatgctacccattagtacaagtgtatggattcgtgtattaagtccacaggagactccatggaaggagagattaaagctcttcagagaaggccgatagcgacagaagagtttccaatgcagccagagtgaggttgaggtgccggagcctttccgtggagggatctgtcagaggggatgtgggctgcagaggggaccccacgtaaggaaaggagggtcccaggccctgggtagtgaaaggagaaggtagtcgaggcagtcaagggtgaccctacacgcaggaggcacgccacaccagatcacgccacacgcaggctgctcccaactggcagggcctgacccagccaggaagggccaggtcctaggattccacagtgccaggagtgcccgaaggggccaggtcccaggattcccacagccccaggtgtgcctggaagacccgggtcccaggattcccacagccccagctatgcttgggggggccgagtcccaggattcccacagccccaggtgtgcctggaagacccgggtcccaggattcccacagccccaagagttcccggaagagctgggtcccaggattcccacagccccagctatgcttgggggggccgggtcccaggattcccacagccccaggtgtgcctggaagacccaggtcccaggattcccacagccctggatgtgcctggaggggctgtgccacctctgcagagatggaagggctcgtgttgaagcctgaggatttcgccctcaggtccaggtcagaacatcccagcaccactttcaggccatgtctgccctgcagttttgaccactgaattggtcttaagagtggccacccattcccctccaagtgagggggcaagacacaagtaggggacgggtcactttctgtcaccctgaaaatacgctgggcacgacacaagtaggggatgggtcactttctgtcaccctgaaaatacgctgggcacgacacaaggggggctgatgaagtcaggcccgcccctccaagtccacctcgaaatcaccgtctggcttcctcgcacttcccaccacctgacaccgccaagccccttgcttcagattttctgtggtctgtattcatacccttgcttcagattttctgtagtctatattcatgcctgcttaggcccctacaaaagtcctcataaaaccagcaccacctttatctgcctccaaaacacacactgctttcccatcaggaagatcagcaatgtggtttccggcctggttcttagtcaaaaagttagtgtctggtggtttctggcctttttgcaggacggggcgcagggaacggctgcgcggccaggcagcctccgctgtccacctccagccccggttttgcagccgtgtgtgatatcaagggatagagttagggtttctgtgggttttgtttttgctgaggaaaggatgtgcaggtcgatagctattgtttcctttccattcctgtgattctctttacatctgtatatatctatcacaccatgctgactttgtgatgagtcctgttcctcagaaacatcaagctgggttccttttcaaagaaacacacagatcatatttctccatctcattttgttttcacagggagcttttcttatcaacaaagtcgcatgcttttttttttggatataatgtttatcacgtctggagagccataaacagtaaatacagaggatatcaatgcccagaatagttattttgatgaaatcctatttttagataataaatttcaagatgtgtctatagtgtattgtttaaaacaactgaagacatttgagacgtacataaagtagacatttttaatttagggaaacttatatgcccttttttaagaagccattctaataaaataatctgactaattggcccaaaatacaataagtatcactttctaacagagaccaaagggaagctgagaggctttccttttatgtactaccgttggatcgctgcagccgcctctcataacacccaacagaacccggtgaggctctgtgggcttcccgcggccctcagggaggctgcagagtcccctagtccatgtcagggagccgccatcccacatacctccaaagcctgtcctcgcctgcagtttttgcagagctcgcggttggaggtggaaatttagaagccctgtgttgcaggagaggcagtagcacccccaggcagctcttagcagggacagaccaccccccgcctcgctggtattttagggtcttttggtattttgccactgtgtggggctaggcgggtggctggaggacacggtgtaggccttgccgctgtctgggttcctcgccactgcaggagcagggctgtttctggaaacactgggctgctggtgacccgtcaaacttctcccacaaattctgaatccgagaaagtgaaggaaggatggtggggaagtgaggaggcaggagcagaggccacagggaccaaccagagatgcggtggagacagaggagcttccttctcaggctgtttctgggaagcctgagaggcggccagcaccaccctccgctcactctcccctcagcctcttcgcttcccttctcaaccctttctctcctcctcgcctcttccctttcttgctgtcttgttagtccctgtcccaaaactcctggctcctttgttctgctgccgtggcccccacccaggaggaggtctcaggcaccatccccccacgagggatccacacaacaggttcatgctggggctgggggagccccgctgggttcctgatgccttgtgcacagggagttgctgcagtcatttttggactctcctgaatgtgtccacatgttctgacctcccaccagaaggaacgctggtggccacatctctagagatctatttacttttttgagaccggcttatgagattggctaatttttgtatttttggtagagatggggtctcaccatgttgcccaggctagtctcgaactcctggcctcaagtgatctgcccacctcggcctcccagagtgctgggattacaggcatgagccaccgcgctggcctctagagattcacaccaaacaatatcactcctgcgggaaccgcagacagatcaaaccctggtgagaggaacactttatttcccaactcatcatcctaagccaaggttggagggatgagcattccctaaacaccaaggcgagatcacctggtcccagtgcctcttttcacacaggccctagatttctatctctctgcagtttatgcatcggtaaaaaaaaaaaaatctctcccagtgtgccccgttagttttcagcattttgtaagcaaaatgaacttaacacatagtaattctaattgaaggtatgtacataaaaagcatgatagaatggcaatattgtatcaatggatgtacatttgtaatatttgtaaaaaaaaatccaaaaccttaaaatatgaatttacatgttaatttgcctctaagttctataaattgcacttcagtgatatctaataagtgaatgtttctgttaagtaaataaaaatattcagtaaaa

SEQ ID NO: 500 - DNA, 1810 bp, Homo sapiens
  ENST00000381310
acacatgggcctgtggagcccagtcccaggcaacagtgtccccagagccccagtgatggctgggttgggtctggggcactcccagggagctccccaaggtccgcacgatgggaagactgacaggtcctcaggaccaggccgcagacggacagagaggaccaggctccctgggctcctgggtggggctccgctgactgctggctctccccacaggtggaacgtcctggggctgcagggcgcgctcctgtcccacttcgtggagcccgtgtacctgcagagcatcgtggtgggcagcctgcaccacacgggccacctcgcacgcgtcatgagccaccgcatggagggtgtcggccagctgcccgcctcctaccggcacaaccggcctctcctcagcggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggagggatgggaccgtgtctggggggcgacgtggcgggtcggccggttccctgcattcgttttactttggtgtcccagaaacacgcgagtgtgcaatgtttggacgagcaacaacacaaattcagaacgtgcctctttccagatcgctggccccagaaccctgtcccccacacccaggggcacatgcactgttgagttagcgccgactcttcctgtggagtctgagggaggggctccattcaggcaaaggggttttagctgcagccttggaaggaggcaccgacacgacaccaggcaggagtgagcctcaggccccgtccctgcaccccacccctgcgtgcgcctcttggtgatgctggggtctcactagcttgagggggcacatgaagataagccacaaatgaagagaaaagccatgcccaccccagccccagagaaaccaataagaatcctctattattttcactattcatttaggtttttatactccacctcctttcaaaaaagatttaagatgtacgacattaccgaacacctaaaatagaaccagagaaacgaaagccattcccacaaagtgaaggaacagtttccaaaacccctgcgaggcagagttaagacctgtgacgtggggagcctggaaacacccggcccacgcgtgctgcagatgtggggagcctggaaacacccggcccacgcgtgctgcagatgtggggagcctggaaacacccggcccacgcgtgctgcagatgtggggagtctggaaacacccggcccacgcgtgctgcagatgtggggagcccggaaacacctggcccatgcctgttcagtccgtcatggcgtttggtttatggtggccgatactaagagccactgaggtctgggttgtgtaagggttagctaccaccctataacctccctaccaggtaataaggagaccaagtctttgatcaaattctgattttttaactaaattttcattagaaagcaagcacaaaataaaatcaaaacaacctttaccttc

SEQ ID NO: 501 - DNA, 768 bp, Homo sapiens
  ENST00000474762
gatctgcgaggaggcatgaatgagagggagacacccggccagctgggcttggggaacgcgtcaggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggagggatgggaccgtgtctggggggcgacgtggcgggtcggccggttccctgcattcgttttactttggtgtcccagaaacacgcgagtgtgcaatgtttggacgagcaacaacacaaattcagaacgtgcctctttccagatcgctggccccagaaccctgtcccccacacccaggggcacatgcactgttgagttagcgccgactcttcctgtggagtctgagggaggggctccattcaggcaaaggggttttagctgcagccttggaaggaggcaccgacacgacaccaggcaggagtgagcctca

SEQ ID NO: 502 - DNA, 599 bp, Homo sapiens
  ENST00000490172
attcatagcctgggtgctccaaaagtgctcttatttgcctggtttgatcttcacatcacctcgtgaagtagagaagtcacctgtcacagagcggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggagggatgggaccgtgtctggggggcgacgtggcgggtcggccggttccctgcattcgttttactttggtgtcccagaaacacgcgagtgtgcaatgtttggacgagcaac

SEQ ID NO: 503 - DNA, 703 bp, Homo sapiens
  ENST00000381305
agaaaagagagcagcatttgttagcacacatgggcctgtggagcccagtcccaggcaacagtgtccccagagccccagtgatggctgggttgggtctggggcactcccagggagctccccaaggtggaacgtcctggggctgcagggcgcgctcctgtcccacttcgtggagcccgtgtacctgcagagcatcgtggtgggcagcctgcaccacacgggccacctcgcacgcgtcatgagccaccgcatggagggtgtcggccagctgcccgcctcctaccggcacaaccggcctctcctcagcggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggag

SEQ ID NO: 504 - DNA, 683 bp, Homo sapiens
  ENST00000477140
catttgttagcacacatgggcctgtggagcccagtcccaggcaacagtgtccccagagccccagtgatggctgggttgggtctggggcactcccagggagctccccaaggtccgcacgatgggaagactgacaggtcctcaggaccaggccgcagacggacagagaggaccaggctccctgggctcctgggtggggctccgctgactgctggctctccccacaggtggaacgtcctggggctgcagggcgcgctcctgtcccacttcgtggagcccgtgtacctgcagagcatcgtggtgggcagcctgcaccacacgggccacctcgcacgcgtcatgagccaccgcatggagggtgtcggccagctgcccgcctcctaccggcacaaccggcctctcctcagcgcggtgtctgaaggagttctgaaaacagaatcactagtgttgggctcacccaagaggccccacctgcccacctggccgcccacctgcccacctgcccacctggccgcccacaggaggcgatgctgaggaagagccaggtgggcgaggaggggcggggggcgccaaggtcacgtggccagagcgggtcttcggaacccagggccccgggccctccacaccctccagaggctgccaggttactccgcgagtactgggccggcttcgcaccaggattcccc

SEQ ID NO: 505 - DNA, 1741 bp, Homo sapiens
  ENST00000469464
acagaggcaggaagactgctggatgccgcaaggacttcctgtggagaaaatgtctgttctgttgcctgtgtgatctcagggccccacagaacacaatccatcacccatggggcagaacgtgtgaaaacagcaagaccggcagaagcaagcggcgcgaggactcagagcgatcgatattcgtgcggttaaaagaaggtggctaccggctgcgagagaacatcctcttccatctctacgtgagcacctccccctgtggagacgcaagactccactctccctacgagatcaccacagacctgcacagcagcaaacacctcgtcaggaagttccgcgggcacctgcgcaccaagatcgagtccggggaagggacggtccccgtgcgtggccccagcgcagtgcagacctgggacggcgtcctgctgggggagcagctgatcaccatgtcctgcacggacaagatcgccaggtgaggcccacggcttcctctcgaggatgttggctgcggccggtggggagtgccaagccccaggctccctgcatcccacttctggtgaggtcagtgatgctgggcacatgcggtcagggccctgtgcctgagccgtggaactccacagccattccacatgttcagtcccacaccctgaggccaaggcaccccgagtccctgagggagcaaggccctgccacccgaggctgccgctgcagaggcaaacagccccgagcaaggcccggcaaccccaggctgtggctgcatggggcaaacacagcctggcctgaggctgccggccagtcggggtggccataggctaacgagaagccagggcctccctccccactgggctttccacaaaaacctgactaatgtccagggacagccaaaggccttgaggtcagctgggtggaacacctttcccctaccatcccgagatattgtcttcttggatggagttttcaaagcctccatgtggaggtctcgggatgagaggcctcggctgagctctgtgcagaggagcaggaagctgcagaatgggcacccgcctccctcccagcacctccagtcgctgccacgccccaagctcctgagctgctctgcccaagacctcccccaaccttggtctgacgcgttgagacctccccctaccttggcctgatgccccgagacctcccccaacctcggtctgatgccccgagacctccttgacctcagtctgataccctaagacctcccccaacctcagtctgatgccccaagacctcccccaggttagtctgatgccctgagacttcccccaaccttggtctaatgtcccaagacctctccgtcctcgatctgaccccgagacctcccccacgttggtgacacccccacgttggtgacaccctgagacctcccccacgttgctctgaggccccgaggcctcccccacgttgctctgatgccctgaggcctccccaacgtggatttgaggccctgaggcctccccaacgtggatctgaggccctaagacctccccaacgttgatctgaagcccctagacctcccccacattggtctgacgccctgaaagcgccatccccaatgcaggacatttctgtaactttggtttggaaaataggggtcacaggtgtggggacagcatgagtttccctaaaagagccatgaattccccacaagcctgataaactaacaacaatgtggtcacaggaagtctgggttgagggacccagaacacccttggac

SEQ ID NO: 506 - DNA, 1693 bp, Homo sapiens
  ENST00000432715
gttccactgtgcacggtggggaaactgaggctcggaggggacaaggaaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacgctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgagcatcctgtttgctgacatcgtgggtttcacgggcttggcatcccagtgcacagcccaggagctggtgaaactcctcaatgagctcttcggcaagttcgatgaattagccacggagaaccactgtcgccgcatcaagattctcggggactgctactactgcgtgtcgggcctcacccagcccaagactgaccatgcccactgctgtgtggagatgggactcgacatgattgataccatcacatctgtggctgaagccaccgaggtggatctgaacatgcgtgtgggtctgcacacgggcagggtcctctgtggtgtcctgggcttgcgcaagtggcagtacgacgtgtggtccaatgatgtgaccttggccaatgtcatggaagccgctggcctgccagggaaggttcatatcacaaagacgaccctagcgtgcttgaatggggactacgaggtagaaccgggttacggacatgagaggaacagtttcttgaaaactcataacatcgaaaccttttttattgtgccatcccatcgccgaaagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaaggttcagatccatccctcactgagtggcctggatgtcctcctggggttttggtctcccaccctgcaacggggacgactgtgcacgtagcttcaggtcctgcccaacagccactgtcaccagtgctgcaaggatgagctcctgccatcagcccttatcccccagggcattcacgccagctctgttcttctctcagcactctctcctgatcgtaaacataattgattatggaaaatatggagaacacaaagatgcacaagggagaaaatgaaaagcatttatctggaatcctaccatctcacaaaaaagctatcatgaacattttgttccttccagtttcttaagtttgtgtgtctgtatttttttaataaacttgactggatggta

SEQ ID NO: 507 - DNA, 12503 bp, Homo sapiens
  ENST00000297323
gcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacgctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgagcatcctgtttgctgacatcgtgggtttcacgggcttggcatcccagtgcacagcccaggagctggtgaaactcctcaatgagctcttcggcaagttcgatgaattagccacggagaaccactgtcgccgcatcaagattctcggggactgctactactgcgtgtcgggcctcacccagcccaagactgaccatgcccactgctgtgtggagatgggactcgacatgattgataccatcacatctgtggctgaagccaccgaggtggatctgaacatgcgtgtgggtctgcacacgggcagggtcctctgtggtgtcctgggcttgcgcaagtggcagtacgacgtgtggtccaatgatgtgaccttggccaatgtcatggaagccgctggcctgccagggaaggttcatatcacaaagacgaccctagcgtgcttgaatggggactacgaggtagaaccgggttacggacatgagaggaacagtttcttgaaaactcataacatcgaaaccttttttattgtgccatcccatcgccgaaagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaagcggagggcattaagaacagcctcggaaaaactcagaaaccgctcatctttttctaccaacgttgtctacaccaccccgggcactcgcgtcaacaggtacatcagccgcctcttagaagcccgccagacagagctggagatggcagacctgaacttctttaccctgaagtacaaacatgtcgaacgggagcaaaagtaccaccagcttcaggacgagtatttcaccagcgccgttgtcctcaccctcatcctggctgccttatttggccttgtctaccttctaatattcccacagagtgtggtcgtcctgctcctgctagtattctgcatctgcttcctggtggcctgtgtcctgtacctgcacatcacccgggtccagtgttttccagggtgcctgacgattcagattcgcactgtcctgtgtattttcatagtggtcttaatctactcagtagcccaaggttgtgtggtgggctgcctgccttgggcctggagctccaagcccaacagttccctggtggtcctttcgtctgggggccagcgcacagccctgcccaccctgccctgcgagtctacacaccatgccctgctctgctgcctggtgggcaccctcccgctagccatatttttccgggtgtcctccttgccaaaaatgatcctgctctccgggctcaccacgtcctacatcctcgttctggagctcagcggatacaccaggactgggggtggtgccgtctccgggcgcagctacgagccgattgtggccatcctgctcttctcctgtgcgctggccctgcatgccaggcaggtggacatcaggctgaggctggactacctctgggccgcacaggcagaggaggagcgagaggacatggagaaggtgaagctggacaacaggcgcatcctcttcaacctcctgccggcccacgtcgcccagcacttcctcatgtccaaccctcggaacatggacctctactaccagtcctactcccaggtgggcgtcatgtttgcctccatccccaacttcaatgacttctacatcgagctggacggcaacaacatgggggtggagtgtctgcggcttctcaacgagatcatcgccgactttgacgagctcatggaaaaagacttttacaaggacatagagaagatcaagaccatcgggagcacctacatggccgctgtggggctagcgcccacctcggggaccaaggctaagaagtccatctcctcccacctgagcacgctggcggactttgccattgagatgtttgacgttctggatgaaatcaactaccagtcttacaacgactttgtcctccgagttggcatcaatgttggccctgtggtggctggagtgattggcgctcgcaggccccagtacgacatctggggaaacacagtcaacgtggccagtcggatggatagcacaggggtccagggcagaatccaggtgactgaggaagtccaccggctgctgagaaggtgcccctaccactttgtgtgccgaggcaaagtcagtgtcaagggcaaaggcgagatgttgacatactttctagaaggcaggactgatggaaacggctcccaaatcaggtccctgggcttggatcggaaaatgtgtccatttgggagagctggccttcagggcagacgtccccccgtgtgccccatgcctggcgtctcagtcagggctgggctccctccacactccccaggccagtacctgccctctgcagcagctgggaaggaggcttagtggagcccacgtgggcctctggggtgcacatggggtgggaatgctccgggggtgacacaggccacggtggctccagccaggaccagccagaccagcagagcagggagccacttgccagggtggaggaggagcattgtccaggcatggcctgtggcccgagggccaaccaccgagcaggcacagcacagcagtgactcggtgaggggaggacacccgactgtgcacacttccaggcctccctggagaggtgtccactccatccttccctccgtggcgtagggagcactgtttctttccagcaagcctgttcaggtttggccaggtcggcatcaatgtaaggaccttcagagcatcccagggttacagcaagagccactgaggtgtggctggcagagcaactgaggagctctgcgagagtgtgccctctgagacagccctgtccgccccgcccaggtgggacctgacatacaggcggctccagccctgggcagcggcttcaagagccagagtgggaagtcaggcctctctgggaaggtcacaaggcctggggttgttcacaccacaggcacaatacagagctgtccactcttgaactggaccgtctggggagaattgagaagctgcctctcactgcatggatagtggtggctgctggctttcaagcgtggttttttgctaagagccagaggcaggtcttctggagttctcaggggggccctgtgaccccctctccacaaccatggccagcatcggcttcttgctgcacctgtgcattctccacccctccgccaatggcttccagctcctaaaacacctggacattccccatcctgcaccggcactgtgtttgttcagagaaaacgaagggtgtcatttcttcttttccctgtggcatcgtggatcctttacatttagcaacaacagtgtgaggctccacttctgttgaatatgagcggctgtcacacccatgagcaagtttccttgatggaagatgctgtttctccggcagaaccaaccctccaggacgaagtttcagaattggctgatggtcgtgagtgcaggtgtccctgttgtaatttgcagggaaattgactgcaggtgatagtgttgacgtctgacgtctgacaacctcctatgtgcatgtctaaatagtcacaatgaagatgaaaataaggatgatggggacggggtccaggagggccactgggaaggcactatccagaaatagtggacagaggtctggcatgtggaaaccttggatctcggtcacagggaggaaggcagctagaaatgggagggaagcttctgggtaggcaccatagtaggggaatgtctaaagacccactgctctgagatgtggtcagagaggtttctgtggactgcagatgaggcctgagccctgcctatgctcaaagccagcagggttgggggtccgcctcctcactgctcctcaacagctgtaaccctttcctgagggccccgacttttcagaataggagcagagagaagcccagacttccttccctggagtgtagacctgtgtgtgggacctgctccaggctgatccctgtccgcacaggtgggtgatgtccttggctgctgccgtcagaggcagccccctgcacagggaggggctgatcctgcctcagctgtgtggccatgtgggggcagcaggggcctgggccatagctgggggaggccagaccctgagggctttgcagggcggccagtgcagtgatgcctggcgcttccagctgagacaggagtccggacagaggtgggcagggtggatggcttcgggcagggaaggcgggtagaggctgcatgtgggggcccctgtctgcctgtccttagggtgtggattaggctctggcttctgtgatggtgcaagaggcaggatggtctccagacaccttcttgcagagtgattttgaccaatgcctttccagcaccttcccctggttatgacagggagctcccaggccaggccacatgaccccacaggtaggctgaccccatggacccactggagactttgagggcagagctcgggcacctttcatcttccttgggtggtcctcatgtcgctgtccgctcatgttcctggtgttctggcatcaccttgtgccggtgggggctgggctcccgtgaggtcctagggcagaaggaggtgcttgcagggcctctcgctgctactgggacatccacaggacctaatgtttatgtggaatctccaggctgccatcgagggctcctgagctcatcctgaggacccagggtccatctgagctggctgtgggctgagatcctggctggggccctgctgtcaacctctcctccaggccctgccttgtccctgctcctgtgctttcctctcttcaggacaaatggtttgtccttatggtcccctttccactaggattttctcatcctcatctgtctatcccagccggatttaaagcagtcacttcagacaggagccacagggagcctgtgagggagtagtgcggtggtggtgagtgtggctgccctggctcccccagctcaccgtggtgctgtccttgacccacgagctgttgagaagggtgcagagcccctggcacagccaaccctgttgcccccagtgccgctgcccagcttcggccatccaggtggtgggtagacagaggagtgaaccccaaaggtgtccatgccccagttctaagccctgtggccaggtgctgtcacacagcaaaggggactttgcaggtggaattagggttagggatctaaggatgggaggggaacttggtttatctgggtgggctcagtgaccccttggaatggctgagggaggcaggagagcctggaaagattcgaagtgtcacagagatggtgccgtcattgctggcttaaagacaaggggccaggagccaacaccagaggccactccacaaccccagcgccagtcagcaaggaagccgggtgtcgctcacacaaccagaaggagctgagtttggcaacaacccaagtgagcctgaagcagattcgccccagagcctccaggcgtgagtggagcccagtccagcgacaccttggtttggcctgtgagactgagaagagagccagccacgccatgctgtgcctggggtccacagagccgggaggtcacacatgtacatcctggaagctgcccaaggtgtggccacttgtagggcagtgagaggaagccgtcgcggggaccatgctgccttctctgggctcacgactgttctggaaaggaccccatggcagacttggcaaggtctccacttcaggggcaaacatctccatcatcagcaactccaaaccccagccacttcctgggagttcaggaactgtgtttagccataatgtcccttggggtttggtgaaaaacaacttcctttttatttgtgggaaaactgtattatattgccttatttatttttaatcatgtacaatattcatgtacaaatgttagagccattcgggtaggattctctctaaattatttattgaagaggctttgtaaatagtgcaccagtgacaggtgctgcctgtttactcgtaccaaaaatgaagacaagccccacacccacctcagcccttgcttggccatgctgtggccctttggaaatgaccctgtgtgctcccctcgcgacccttgcatgcctttcatgcctgatgccgtagagtagaacacagccccggaatgcttccagttgcttgcaagggaccatgccggcccgggtggtccatgcctgcggggtgtctgtatcctgcaggaggacgcccctacagacccagcaacccaagttgccagcccgtgtttctcagactttaaagccaccagggcttctggaacacctgtcatagaagcaataactctaactctatactgtagagatgagtctggtccgaagcagattagtaatttagagataagccatgcatacaagtttgccccattctctggcttggggtggtgggaggcggggagctgccactcccaaagcctccaccccttcctgaagacccagctatgaaaccgcagttcctgtgggttgggctgcccaggctggtcagagctcagcaccccaggtctggtgagcagacagagccggcgttaaaccccgatcaggtcattgtcaccacacccttgcttggatgaggaaggaaggaggcaaaggcacccactccatccaagatccgttccaattgatgagcctcagtactggcctcacactgaccaacggtggtatgctgcagtttgttggtttggtgcagagtctaaaggataacatatcaaggcttacctgtgataggccattttaaggaaatggtggcactctgaaggctgtccccattcaccttccacaatgctggtaccatcctggtagaagagccctctgaacaggacacctgttcaggcctgggggccccatgctaggcttgcctgggtgtgagaaggtcgaactgggtggcttaggccttcaaattgagcttgggggtgtccaagagaggggtcttattcgaggaactcacataccccaaataaccatcagtgcacaaatcattccatgctctttggcaccaggcaggagatgctgcaggcaggtgtccgtagttggcaaaaatgggcagtaggggaaatggagttgcttcaacctttctcagtcccggccctcactgcacccaccaagtcaagcagagctgggtgggctgagaccagcatcccagctggactgagcctggggggaggggctggagccaaggagcccccctgggtgggggcatcaggagcaggggcagggcctgaggactgctccccctgcatggagggcaggccaggatggagcccagggtagactttgaggaaggctcagtgggctcagcagaaggaaggctcttctcatagttgtggtttttcacagatggatttgggtgatctgagtgtggtcaggccctgccgttggggaatgaatgccacacggggtttgtctgtaagctgcagtgtctgtgattctgtgtgaactgacagcagggagctgaaggacaggccccggccttgggagaggacacgggcatgggctgctggatgcagggctcccagggctgtgaaggcagaggggtctctggaggcagacagggtgggctgggggccagcagcagggggcagagccccagccagggcagctgcttcctgcacatagacattcctcctgcgcagggccaagtgcccatgagcacagccccagacagacacggtggggagcttggagccctccgctcacctagaggagccctgggacacgcactggaaagtattctaggggcttcctgccttatccttctgtttgttcatacacttagtgaaagcagatcctgtactaggatgtgaggatatctgtcacctgcgtggtccattccataaacaccagattccatttcagttgccacacattttggggctagacttccctaaacaacatgccattgtgaaataatgcatatatttgtatttttaaatttccctgaaaatttaatctattctgttccatatgaagtctgtttcactaccttaaaaaatagatactccactagaggctgtgcttaattcaaatccatgtgtgtgcctgcattacatgtgtgaacacgtgtttctgtcgtgtgtgtcatgcacatctgtgtgttgcatagcataagccaaatgaaaatcatttgttcatgggattcatatgaggaacaaaattaaatttgaatacagtcagataactgccacgcagggcatttggggaaccatccccgaatgccctgatgtgatttccctcagaaaatccttgttattagaggagaaggtctgggcaggggcagcagcatctcagacatcaagtcaactttatcatctactacatcagcactgaagtccaggggcattgaggcactaactaggttccattttctttggtttggttacttattttttctttttgggttctcggtgtgcagaggctgtagagagagcctcagggcggtgaccgctgcaggaattcggccctccagctcccctccagttaccaggagccgatttggaggccaggccttcccagctgagtgtctgtcagcttcattctctctcagctgtgcagtggaagagcaacaacagacaggtgaccttcttgggttgtgcttcacaatggactgggaaaaacatctttgaaatcaggaaatcaggccgggcgcagtggctcatgcctgtaagcccagcactttgggaggcggaggcgggtggatccattgaggtcaggagctcaagaccagcctggtcaacatggtgaaaccccgtctctactaaaaatacaaaaaaaaaattagctgggcgtgttggcgggagcctgtagtcccagctacacgggaggctaaggtgggagaattgcttgaacccgggaggcggaggttgcagtgagctgagattgcaccattgcactccagcctgggcgacagagcaagactctctcaaaaaaaaaaaaaaaagaaagaaagaaatcagaaaatcgaccacagtggtagccacctggcctaatgctgtgtttttgtacctgacaggggtcactcattttaggcacaactccttcattctttgtgaaattagtgagtttccttctacccgtcaccagattcaatatgttctattaatacaccgataaccacaggggaagggcacttgtcgctctcccacctggttaccacagtctccatgggtcttttgccgtgaccacaaataaaggaaacactcatcactagtatctaagtcgggctttacagtaactatgcaccttctgtgtgcttcacctcactctctacttcaaacagcccatggagggaggtattattatactccttatgttgacagtgaagaatctgaggcccagagaggttggggacttgagtaaagtcacacagccctgagaggcaggaccagggttccattcctgctctatccagttccaagcccttgtgttttccattatgtttagtgcctctttgctaacagcaacatctgcaagatttgtgttggttttgatggagaactctagctcatccacatgctagtgcccaagtggtggaggggccacctcagcaggtgggttctgaatgcagccaaggctgtccccgcaatgggtgagactcgctccaactgcccgccctcagagcaggtgcctaagtcctccctggcactggcaggccttacctcacattgctaaattaaagcaatgcaattcctcttgggtaagaggaattcctccttctttactaactgatccccagcaaggaaataaaatgttaggctttaaaaatccctactttgtcatatcagactatattctaaaactatatttgagcgaaacctgtcattgcgtctaatttcaaatatacagaatctccttaagagctgttgccttatttttttgtaaagcctctctgacatcaaatggggagaaatggtggcacctccagacaccctgaaactacacaccatttcttccctgctcagcttctgctcaggagttctgtgagctatgggaaggccattggttgtatttgctacttttactttcatcttcctctgctgtagagccatttaatgttattgtcatatgctgctggtgaggtaaaggtgggtccgggtgccttcccaggggttagaggatgttcaaagggccgatttcagcaggagttcagagggcttatgatggatggtgagagatttgacaaccaccagagcacatgtgctctgaccctctcctgggcattggttcctgctggtaccgggcggttcagaccttcaaataggttgctttcaaaagagctttcaggcacttattgagaattaatgtttaaacagacataatagcctagatgaactcccaagagatctattaaatcttgtgggctgaataaatatctcgtgcaggactgtgcaacagtagcccagagcatcctgcctgtgggcatccacctcccaggtgagggcagtgggaagctggcccgacggcagccagaacttgtttctcacctcccaccagcaaccccccacccaactctgggccccaggcacacgaagcacaagtctcaggggaccattcccacattgggggatcctgagggagcccatcaccgcctcttgcatacaactgtccactaggaggcacgcccagtgtgggagagatgtatggtcttgccttccacctgtaaaaactgcacatatgcaagccatttgcactctggaactgcatgccgtgaaaactcctaatggtgtggaacttagtttgaatttgaaatcacgccgcatgcacaaagggacaggcccaggcccgacctcaggtcatccgcccgctggctgcagagcatccctgggagccaaggcgaggcccgtggagcctgagctttgtgtagctcgagctttgtgtagctcgtgcacttattatgcaccacctcccttcagtcaccactcctcttcctccgccatcctcatttatactgattgcacaccccccgctcaaacaacaatgtccttattatgatgaccatctcgtagtggtacattccattcctatttaaggtaagcccaaagcccacttttggattttctcgactgtccgagaaaagttgtgtaagcgcctgcgttcttctgggtttggctagatagggttgtgtccctctatggaatggagagtgatgtgggcaagggtgtcattttctcgcacaatacaactcactgaggatgcttctgtagaagtgagaaacacgatgagtacattcagaattacaataactcactctcactgggtaacttctcatgatagatttgtatgatcaatacgggtctatttttatgtcaactgaacactgtagggtaccttccagtctttttcaagattgttaaattgagacaagtaattgaataatttgtcctatttttattttaaaaaaagtgaatggactgaaatgttaaatgtgaatgtacatttcttaattgcaacttttctactgagtgtttgcactatactttctggaatcttatttaacaaaaataaagggaaaaaattgcttgactaaa

SEQ ID NO: 508 - DNA, 763 bp, Homo sapiens
  ENST00000468353
ggactctagcagggtgagttgttttctgtaaggtccctgcgtattaattttagtttatatttatactttcagaagtgttaagtgtaaaaaggacttcttttatccgtgaaatcactttttgaagatttcaaaatgtctgtataatacatagatttaaaataaaatttctaataactctataaaacctacgtgaacaaaataataaaatttatttagagcatatcaaagaagacacaaatgaatggaaatttgtaccatttctgaaatggaagaattcaatataatgaaaataccaagttaatctatccagttaacttcagtgccaatcaaagttacaatgcaagtggaaggaagggaagtattattctttgtaatttaaagacttcaggtttctttttttaactttggcaagcttttcacctgggagaataaacaaatgaaaaaagccaagagacatgtgaggagggtgaaaaacggatgtggacctagcagcttgcaggtcatctgcacattccactataggaagtattaactgtgcacgtgaatcaccttggtaatcagagggtattttctaaattaacatttcttattcagtgttttccagggtgcctgacgattcagattcgcactgtcctgtgtattttcatagtggtcttaatctactcagtagcccaaggttgtgtggtgggctgcctgccttgggcctggagctccaagcccaacagttccctggtggtcctttcgtctgggggccagcgcacag

SEQ ID NO: 509 - DNA, 1647 bp, Homo sapiens
  ENST00000621543
gcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacgctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgagcatcctgtttgctgacatcgtgggtttcacgggcttggcatcccagtgcacagcccaggagctggtgaaactcctcaatgagctcttcggcaagttcgatgaattagccacggagaaccactgtcgccgcatcaagattctcggggactgctactactgcgtgtcgggcctcacccagcccaagactgaccatgcccactgctgtgtggagatgggactcgacatgattgataccatcacatctgtggctgaagccaccgaggtggatctgaacatgcgtgtgggtctgcacacgggcagggtcctctgtggtgtcctgggcttgcgcaagtggcagtacgacgtgtggtccaatgatgtgaccttggccaatgtcatggaagccgctggcctgccagggaaggttcatatcacaaagacgaccctagcgtgcttgaatggggactacgaggtagaaccgggttacggacatgagaggaacagtttcttgaaaactcataacatcgaaaccttttttattgtgccatcccatcgccgaaagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaaggttcagatccatccctcactgagtggcctggatgtcctcctggggttttggtctcccaccctgcaacggggacgactgtgcacgtagcttcaggtcctgcccaacagccactgtcaccagtgctgcaaggatgagctcctgccatcagcccttatcccccagggcattcacgccagctctgttcttctctcagcactctctcctgatcgtaaacataattgattatggaaaatatggagaacacaaagatgcacaagggagaaaatgaaaagcatttatctggaatcctaccatctcacaaaaaagctatcatgaacattttgttccttccagtttcttaagtttgtgtgtctgtatttttttaataaacttgactggatggt

SEQ ID NO: 510 - DNA, 6487 bp, Homo sapiens
  ENST00000304166
gcgagcgtggtccccgcgtgcgcacacgcacacgccgccgcgcagggacacacggaccccggccgccagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcagcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaattgtcccctccttgttttggtactggtcccacccactgtggtcccctgggccctgaccccagacatgtaaatactcctcaaatttggaaaagttgtcccatcccttccccctttgccccagtgtccctgctcacttccagtcaggtctcagctccaccccactgtttcttggtcagcctcagtgatggcctgaccccagctgtgaggccttgtgagctaaggctgaagagaccttgcctgtgggagctggggtggtacctgccccaacagccccccatcatctgattttgggtgtgacccctcgagtgtgcatgccaccctggggctcttctcagtcctgggcccaagtccctgaagcctagcagagggccagctcgggtggccagaacaccccttggtgcaggcctcctggcactcgcctggcatcttggtgtccgggtgctcagctcctgggtcccagggcagtgggacagctcccaggctcttctcatcagagacttcagtttgggtggggagtctgcaggtcagggaaggttctggtgcttttcgtttgatccaaaaggagctgagagccagaaatgtggctgtgattgcgaaagagacggagtttgggagacccatggaagaaaaccttcgccatctccattgttttacccccagctcaagatggacagggttcttctggtcatctcccttccacctcttccaccctcatggatgccttccagaagctgtctccaaccatgcacaccacagagagcccttaagccctcccctccccatttcccctaagtcaaagccatgactaggatgtaccagccacctgcctctgatgtcggcgaatcctgaagcacctgcacccgaatctggggcccagggctgcccgacccccactcccatggatgatgaggagccccagacaccagctcctctggcctggactcaactattgaaatctctctgagacctctgcaaagatgtcccttttatgcccttgaccttgactcaccatgggctgctggggtgtcgggagaagccacacccaacatgcccattagcagaggctgctgctgatgtggcagctgctccctaccacccgccctggctccccagctgcaggttgcacaccctcagcctgagaatgtaaaatagggcagtgcccagctggggaggtagaggaaagtgctagagtacatggtccgtgtgtggcctagctcattccatgtcagcatttggtgttactcctgtccaaattctgtttgcagacttgtttcatgatgatgctctggaatgcttggggactttgggtggaggaggatgttacttcattttataaagaggaaggggcctgggagacttgggaaaatgtttctggagaggctttcagagtggctggaaaaggctcttgttgctgtaatttagagaggagctctgtgtccttggccagtcaagtaagttcctggatctttggcaaagccagaggaagaaaggagctacctgccctttcctgggcatgcttggtgactcagattgatcttggagtgtgcagtggcccttctaccctgcacctgacctcatgatcccctccacctgcactggtgtgcattactgaagcaagggtcctgtggacatcttgcattttgggcactgctagggggtctgggctgcttggaaggagccatggcctagggttcagggaactagactctatcccagttgggttcagactgctgtgactgtggacacgatgctccttgttctgggctccagttttcccatttgtgagatgaggcaacttccaatgcttctctaggccctgcacgtaagtgatttttccagttcaaagtcaagacaggtaaaagggcattcatcattgtgcctcatatcaggttttgatgaatatatgtgtgtgtgtgtgtgtgtgtgtgtgtgtgtgtgtagagggatggacaggatgctgtttattttccctttcttggaaatggaccttctgtcccttccatttggacaccacagtggaagctggtggcctggaaggaaggattaggtcatggacatttgaacaggtgccttgggcatgatgtatagatgcagtcatatataccttgctggggtggggtgccacctccagtggccagctccagatccaaggagcagccccctggggatggaccccattcattcatcatgactcccaacagttttcattgtggaagaagaaactttggcattatagagacatcatcacaaaacagtaaaaacaaaatcaaccctgaaccccatgcactgtgctgcttcctgagcctggccctgcatcctcatagaggtgccgggttcctattggttagttggttgtttttccgtctgagtgaatttttgccagtcttgtgagcagatgtacctgatgtattctcaatgttccaagaggttctggccttcagggtcacaggcagtagggggacagcataaggtctatgtaaaacccttccctctctgaccctctgttttcaaatctgtaaaatgggcaataagactagatgatttgtatatagcccaatgcatctctggaactctgtctaaacaccagccatctacttggaatgggccccaggactgtggtatttgcctgggccaggaaaggataagaaatcctgtcatgtgaagacagcttgagaggcttgagaaaagtggggctggggagaagcaggcttgtcagactccacccctgttgatgatcattcctgggaaggggtttctcgttctatgcaatcctaaaggacgaaactcacccatgggaggccgaattctccttgggatgaagaaatttctctttccctgtcatgagtgtccagccagggagcagggaggcagtgtcagggagggactctcatcctggaggaaatgggattccaagtcaaggatgctgaggctgtcagggagccagagaggggggtccaagtgcgggatgtgggtggctctgtggttcagtggctctgtggtagttcctagcactgcagacttcatgactccccacttaagtccaagtcacattgtctatcccagtgtgtagctctgtcaccctgcttgacacatccagtggcctacagcgactcttctctaaccccaccccctccaagctgggttctttgtggaagaaggacagggagctagagccaagccctaggcttgagagacacctgcatctataatccccgccaaggatgcccactcacctctctcatctgatcctcactctttgtggaagggaaagctcaaagggactctctctctctctctctttttttttttttttgagtagtacccttgccctcttcatggccacttcaaagtgaagccagcaaagtgataatactttatcatttagtattatcataaagtattaatactttgtcataaagtcctccttgagcccagggaccatggaagtcagctagaagagccctgagcaaggagcaaggacttgggcttctccacgctttgctcctggcttgtttgaccttgactcattccccatatgtctttgaggaggctcacaaaatactaaagctgggaggaaacttggagatctataggtcaaacctccccattgggctgatgagaaaatacacgcaggcctagcatggtgcctgccaccatggtgggatccagtatgttttataaatctgaatgagtaaatggctcaccaatttatgcatagccctgcacatgagcagaatgtgacactcaaagcatccatgcagtacgcatgtaaccttgcacaggagtggggctctggtgaccgaaggttgtccaggactcttgcaggagaagcaatggagtcagtgtggtgtggggagacctactttttaacctgggcttagccacctgctctgtgatccagggcttaccttctttgggcctcggcctcctaatctgggtaatggggaggacttcattggcattgttagtcccacaggccaaggataaggttgaaatgagacggcttgtgtgtgaaaagattttggaaattacacagatgtgggcttgttattgggatgaagactgctggaagggactccttgctgtttatctactgctttgagccctcctaagttaacctgtgcctcatttgtaaaaccaccagcatcaggagtaagggggaggccagagggctcagatggacacagaattctagctttacctgcatccgctgattcagttttctgttgggatcagagtgaggatacttccatatgggtgatagcagccatgcccctgggagtcaacttcaaggatctgggacattttggtgtgcccattccttcttttcctgaactcacagtcttggggtgtttctgcacttggctatgtgtgtcttgtctgatgtctgtcttctgtagctttgcctctatcagggctggagtggtgcagcccctggcatctcagacatggttcctgcctcacttgtgggagctggaccagcctgggtttcatctcccacagtaaagctaagtaagccccacagaccttactgctactgctgctgccattaatgctgtgctcactatcttgtccaggattttaaggatgtcagactgctgtagatgactcaataaatgttttgccatttttc

SEQ ID NO: 511 - DNA, 1889 bp, Homo sapiens
  ENST00000409363
cagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcagcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaattgtcccctccttgttttggtactggtcccacccactgtggtcccctgggccctgaccccagacatgtaaatactcctcaaatttggaaaagttgtcccatcccttccccctttgccccagtgtccctgctcacttccagtcaggtctcagctccaccccactg

SEQ ID NO: 512 - DNA, 466 bp, Homo sapiens
  ENST00000431811
atccaggttttctgggcactcgtgtgtcttgcctgtgccaggtgctgtgggcacacgcacgtcagagctgggctcatgctcacttaggagaggctgaagcttaaccagcgtctgcacaaagggaaaggcgctcagtgcagagctactcctctccacaccacaccccctgccggcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctg

SEQ ID NO: 513 - DNA, 1587 bp, Homo sapiens
  ENST00000396211
cccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttcagctgcgtgcagaaatgctactgcaagccacagcgggctcagcagcactcttgcaagatgtcagaactgtccaccattactctgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctc

SEQ ID NO: 514 - DNA, 1761 bp, Homo sapiens
  ENST00000409489
gccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttaacaaatttaagcccgcgagtccccaagaaagcccgagaggaccccctgcctgtgccctcagaccagcattcactccctttcctcagctgcgtgcagaaatgctactgcaagccacagcgggctcagcagcactcttgcaagatgtcagaactgtccaccattactctgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaatt

SEQ ID NO: 515 - DNA, 441 bp, Homo sapiens
  ENST00000436116
ggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttaacaaatttaagcccgcgagtccccaagaaagcccgagaggaccccctgcctgtgccctcagaccagcattcactccctttcctgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttct

SEQ ID NO: 516 - DNA, 6575 bp, Homo sapiens
  ENST00000614107
gcgagcgtggtccccgcgtgcgcacacgcacacgccgccgcgcagggacacacggaccccggccgccagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcagcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttcagctgcgtgcagaaatgctactgcaagccacagcgggctcagcagcactcttgcaagatgtcagaactgtccaccattactctgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaattgtcccctccttgttttggtactggtcccacccactgtggtcccctgggccctgaccccagacatgtaaatactcctcaaatttggaaaagttgtcccatcccttccccctttgccccagtgtccctgctcacttccagtcaggtctcagctccaccccactgtttcttggtcagcctcagtgatggcctgaccccagctgtgaggccttgtgagctaaggctgaagagaccttgcctgtgggagctggggtggtacctgccccaacagccccccatcatctgattttgggtgtgacccctcgagtgtgcatgccaccctggggctcttctcagtcctgggcccaagtccctgaagcctagcagagggccagctcgggtggccagaacaccccttggtgcaggcctcctggcactcgcctggcatcttggtgtccgggtgctcagctcctgggtcccagggcagtgggacagctcccaggctcttctcatcagagacttcagtttgggtggggagtctgcaggtcagggaaggttctggtgcttttcgtttgatccaaaaggagctgagagccagaaatgtggctgtgattgcgaaagagacggagtttgggagacccatggaagaaaaccttcgccatctccattgttttacccccagctcaagatggacagggttcttctggtcatctcccttccacctcttccaccctcatggatgccttccagaagctgtctccaaccatgcacaccacagagagcccttaagccctcccctccccatttcccctaagtcaaagccatgactaggatgtaccagccacctgcctctgatgtcggcgaatcctgaagcacctgcacccgaatctggggcccagggctgcccgacccccactcccatggatgatgaggagccccagacaccagctcctctggcctggactcaactattgaaatctctctgagacctctgcaaagatgtcccttttatgcccttgaccttgactcaccatgggctgctggggtgtcgggagaagccacacccaacatgcccattagcagaggctgctgctgatgtggcagctgctccctaccacccgccctggctccccagctgcaggttgcacaccctcagcctgagaatgtaaaatagggcagtgcccagctggggaggtagaggaaagtgctagagtacatggtccgtgtgtggcctagctcattccatgtcagcatttggtgttactcctgtccaaattctgtttgcagacttgtttcatgatgatgctctggaatgcttggggactttgggtggaggaggatgttacttcattttataaagaggaaggggcctgggagacttgggaaaatgtttctggagaggctttcagagtggctggaaaaggctcttgttgctgtaatttagagaggagctctgtgtccttggccagtcaagtaagttcctggatctttggcaaagccagaggaagaaaggagctacctgccctttcctgggcatgcttggtgactcagattgatcttggagtgtgcagtggcccttctaccctgcacctgacctcatgatcccctccacctgcactggtgtgcattactgaagcaagggtcctgtggacatcttgcattttgggcactgctagggggtctgggctgcttggaaggagccatggcctagggttcagggaactagactctatcccagttgggttcagactgctgtgactgtggacacgatgctccttgttctgggctccagttttcccatttgtgagatgaggcaacttccaatgcttctctaggccctgcacgtaagtgatttttccagttcaaagtcaagacaggtaaaagggcattcatcattgtgcctcatatcaggttttgatgaatatatgtgtgtgtgtgtgtgtgtgtgtgtgtgtgtgtgtagagggatggacaggatgctgtttattttccctttcttggaaatggaccttctgtcccttccatttggacaccacagtggaagctggtggcctggaaggaaggattaggtcatggacatttgaacaggtgccttgggcatgatgtatagatgcagtcatatataccttgctggggtggggtgccacctccagtggccagctccagatccaaggagcagccccctggggatggaccccattcattcatcatgactcccaacagttttcattgtggaagaagaaactttggcattatagagacatcatcacaaaacagtaaaaacaaaatcaaccctgaaccccatgcactgtgctgcttcctgagcctggccctgcatcctcatagaggtgccgggttcctattggttagttggttgtttttccgtctgagtgaatttttgccagtcttgtgagcagatgtacctgatgtattctcaatgttccaagaggttctggccttcagggtcacaggcagtagggggacagcataaggtctatgtaaaacccttccctctctgaccctctgttttcaaatctgtaaaatgggcaataagactagatgatttgtatatagcccaatgcatctctggaactctgtctaaacaccagccatctacttggaatgggccccaggactgtggtatttgcctgggccaggaaaggataagaaatcctgtcatgtgaagacagcttgagaggcttgagaaaagtggggctggggagaagcaggcttgtcagactccacccctgttgatgatcattcctgggaaggggtttctcgttctatgcaatcctaaaggacgaaactcacccatgggaggccgaattctccttgggatgaagaaatttctctttccctgtcatgagtgtccagccagggagcagggaggcagtgtcagggagggactctcatcctggaggaaatgggattccaagtcaaggatgctgaggctgtcagggagccagagaggggggtccaagtgcgggatgtgggtggctctgtggttcagtggctctgtggtagttcctagcactgcagacttcatgactccccacttaagtccaagtcacattgtctatcccagtgtgtagctctgtcaccctgcttgacacatccagtggcctacagcgactcttctctaaccccaccccctccaagctgggttctttgtggaagaaggacagggagctagagccaagccctaggcttgagagacacctgcatctataatccccgccaaggatgcccactcacctctctcatctgatcctcactctttgtggaagggaaagctcaaagggactctctctctctctctctttttttttttttttgagtagtacccttgccctcttcatggccacttcaaagtgaagccagcaaagtgataatactttatcatttagtattatcataaagtattaatactttgtcataaagtcctccttgagcccagggaccatggaagtcagctagaagagccctgagcaaggagcaaggacttgggcttctccacgctttgctcctggcttgtttgaccttgactcattccccatatgtctttgaggaggctcacaaaatactaaagctgggaggaaacttggagatctataggtcaaacctccccattgggctgatgagaaaatacacgcaggcctagcatggtgcctgccaccatggtgggatccagtatgttttataaatctgaatgagtaaatggctcaccaatttatgcatagccctgcacatgagcagaatgtgacactcaaagcatccatgcagtacgcatgtaaccttgcacaggagtggggctctggtgaccgaaggttgtccaggactcttgcaggagaagcaatggagtcagtgtggtgtggggagacctactttttaacctgggcttagccacctgctctgtgatccagggcttaccttctttgggcctcggcctcctaatctgggtaatggggaggacttcattggcattgttagtcccacaggccaaggataaggttgaaatgagacggcttgtgtgtgaaaagattttggaaattacacagatgtgggcttgttattgggatgaagactgctggaagggactccttgctgtttatctactgctttgagccctcctaagttaacctgtgcctcatttgtaaaaccaccagcatcaggagtaagggggaggccagagggctcagatggacacagaattctagctttacctgcatccgctgattcagttttctgttgggatcagagtgaggatacttccatatgggtgatagcagccatgcccctgggagtcaacttcaaggatctgggacattttggtgtgcccattccttcttttcctgaactcacagtcttggggtgtttctgcacttggctatgtgtgtcttgtctgatgtctgtcttctgtagctttgcctctatcagggctggagtggtgcagcccctggcatctcagacatggttcctgcctcacttgtgggagctggaccagcctgggtttcatctcccacagtaaagctaagtaagccccacagaccttactgctactgctgctgccattaatgctgtgctcactatcttgtccaggattttaaggatgtcagactgctgtagatgactcaataaatgttttgccatttttcctgg

SEQ ID NO: 517 - DNA, 3745 bp, Homo sapiens
  ENST00000403045
catttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcagattacctgagactgggtcatttataatgaacacagatttatttctctcacatctggaagctgggaagtccaagatcaaggcaccagcatttggtgaagccttctttctgtgtcatcccatggcagaagacagaagggcaagagaggaaaccggtccaagcaggatgccttcctttttctgacaggcagcccccagcagtaccatcacaaaccttggtctcttcttgtcaccagcaaagggatgaaggataagtgatgaggagactgaagcacagaggtgaagcagcttgcccaacgtcacactgctgcttagtgatagaggcagtgctagaccccggggctcctgaatgttactgttggaggctcttaacccactgggatcaagaaggtgtcaagagctagactctccctccaggagaatgaacacagacacaaaaccttgcatatatgcttccgggtaaagaacctgcctgcattttggtaccactacgtgctggcctgtcctgggcatgttatatcatgagaaggcagggaaggctgaatcattaaggacatgaatcagattgattctcgtggctttaaaaacaaacactacaggaccagcatgacccgccagcctgttatccacagaggcttgtggtctccattgaaaagaagcaaagacagcacgtcccaactcaaaagattgtgtcatcctaaaggtgaaaggaagagatgatccaagcaaatttaggaccaatagcagactcttcacactgcctggggatagagggaccaccctgggctcctcttactcctggatttacttggatgaccagactcaggacttcatttaaatagaatttggtttcataatggaatcttcagcttgaaatataaatttgtttctgtctccctctgccatctcagcctttcttg

SEQ ID NO: 518 - DNA, 9267 bp, Homo sapiens
  ENST00000264436
gggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaagcaccgtgtcttgaaagaatatttttccttttgatctgactatcgtgaaaatatttttgaaagttcttaatcatagttttccacttttgagcacttgctatctatagacactgtgcaggcttcacatacattacattctttaaccctcacagtaatcctttgaggggggtaagatcattcccattttgtgggtgaggaaattgaccccctaaaatgataattgacttgtcccagctgacttggctagaaagatctggatcctggatttgaatccaggtcagtctgagtccagagcccttgctcttaacagctatggtgaacagacaactttaatccccaggggtggtggttttcatccaggatttgtctctatgactgttctccattgcataatgttagcacgtgaagcaaaggtagggaacaccctgtgctcatcctcatcactgcacgtgaagttcctggtcaatgtggactgtggtgatgctactgtgtgcctctgacaaaggagaggcaagagccttctggttggggcgggaaataccatccatagttggctatttcttgagaaggaaggaaactgacctaggaccaaggtaaacctgacactgtgtctctctagtgcagattcctaactgctaccccaggctccatctctgttctacttcctgattgggtcaaattttaggagggacaacccactcatgcctcagaaaaatctgtcatatgggaaatgcctttaaaagccaatcccttgatgccttcttttaaaaagtagatttcacacttattcatttatccttacatggtatttgttaaggatccactgagcaccaggcattatgctgacgttgaaagagagccatcattatgactagaataataagtggcaaacgatgttgtgagaatggtgaacacgacctctgatgcagccttttgtgtgcgagttgttctacttcgggggtgatgttgattgcctctgcattcaacacactctattcccttgacaatgaggcctcacttaggcctcattgggtggagtcttgctgcagcattattctgggaatttatgccatgggcccactttctattgatagatgaacctgtcagttggttcattcctcatgcattccaaaaacatgcattgagcttgggtcaagggccaggcatgaggataggcatagttcctgccctcaagaagttcatgagcataggaggtgtatagacaaattgcaaaacaggcaagggtaccaaggtggcataagaaagcatcaattaactatcttggggaccagagaaaccctgagagaagcaatggctgctaaggttttaaaacaaagagtaaatttccagtagaatgaaaggattggcagggcatgccacaatgagggaagaatgtgcaaaggtgtggacgcatgaaatgccatgatgggttccgctgagcaacgtggcattgccagagcatgatgtggaagctcaggggttgaggggtcccttcataggtaggcagggctgaatcctaaggaaactggtaggaagtgtggaggagctagacttgtcatggaaggggtttggagccactggagcctttaaatcaggatagagtcatgatcagaattgcattttaggaaaatccctttggtggctgaatggagactgtggactggatgggcgtgggatggtggcatgggagctatgaggcctttttgaaatgtcaatactaaaacatagttgatggcctgctttacacgatgtttcctctacagcagatagtgagtttccaacacaaaatttatttccataaaagtctttggataaagcaccttaagagggattttcaacaaggagaggggagcattcaaagagctaatgtttccagttttattttgtcttggtgtagaattgctgggagaggtgtccagccatcctgccatttcttcttcccttgcacagaatgtggcacatttagctccaggcttgaggacatgcaccaaatgctacagaaacagacatgtggtccaaacaaatctacaggctattagaaaggaaaggccattttctttggctgtggataaaagttggctgaaaactttgaccaatatctgactggagaaaatgtgtattcaagagctcagatttggtgggcagtaggttcatgtctggttgagctactgtgcttggatgtgccagagaaaagggtaacatttgaaccaatgtgctgctctgtggctggctgagctgggaagtggagaggtttctgagcttatttccatcgcaaggcaggcaggaggagagaggacaagaaggattagtggtttcgcagagacaggcttggctccaacggctccttgcgtagtgttggctgcacccaacagtggtgtgagagaaccgtccataccatgtgaccttcctcccaaactgcagaaagagacaccttctagcccagatctggactccctaagagcctcctggcctgcatgcaacccaagtaactgtcctactttggccagttgaccccctccactctcctataactaaaacagggttcttcctctgtgaacagataagttctttttaaaggacttgggggaaattggatgaagagcagtaagttcttacagtaagaaccccactgtaaagcactgccctctgccactgatccatgtagactgaatttgaatcccattccctgtggatgataccgtcacttgctcatggtgacatggcaagacagtcattcagatgtttggcattgttgtagcagggctactgctagtgtgggggaaaatgctataaatccacttctttgattgccatggatttgaaagaaccatttgcccaacagcatgattcgcctctgaaagtctaaaaataattttcaatttttccatgaaggtatgtggagggtaaacacacagcctacgcataggtctgcatgacatgttttttctttttctttctttttttttttttttttttttttttttagacggagctttgctctttgttgcccaggctggagtgcagtggtgcaatcttagctcactgcaacctctgcctcccggtttttcaagcgattcttctgtctcagcctcccaagtagctggaattacaggagcccgccaccttgcccagctaatttttgtatttttagtagagacggggtttcaccatgttggccaggctggtcttgaactcctgacctcgtgatccacctgcctcggcttcccaaagtgctgggattacaggaatgagccactgtgccagctgacacgttttttcttttgtgtgaattttatgttctagttttgggacaagggtaatcagttcttgactagtgaacaaatgagagaacatttaccccttactcattttacacatgcaggtcagcagaagccctagagttggttggcacagtcgcagttgactgagcatagaggaaacaggtctttttacattctctctcatcactggagctcagttgaactctaagaccttagcactcaaagagtctgaaaagaaatgagggagaggctaaatttaagctctccactcccacagaaaggacagggcaccctacaatctaaaagccagtgaggcagcctatcatctgtttcacatctgttctgaaagggatagtttaatgcaagaagtaagaggcctgtagtgactgtaaactcatgaaatgtgcacattggttatctgtgcacatttccacttgcaccataacataagaaagcgtacatggagtgtaattacttccagaagccccgtctaaccaacctattcagatgtggcacactttctgtcataaatgagagaccacacgtagagctcggtcaccaaggaatgcccaacatccctttacctctcacaatgagcagccacgctcaccgggaagcagtgtggggacttcagtggggtgtcccttagtggagaacacctttcatcatttttatagagacaattcccttgagaatgtaggcttttcatcttaggaacaattaggaagaatctccagctgggagtgttcttatgtatacagaaacaatgggtcgcattggttcatacttaggtgatattaggtttggctatattgatgtttggtgccacttaccttctagattttcccaaaagttgggtcattgctatgggaaattggggcctgcagatgggggagaaatgatcattattggtgcagggaaggggttcaggcagagctggagtctgaggctcagtgtgagaaagcactggcagttttctagtagagtcaggtcctgggctcctctcctcacccactgtgtcccgaactgaggccagctgtgatcggcaaattgcttatctctaggtagtttaaagaaaacgtaagagtttggggggtggtgggagaataactgtagaaagaccctaaactcttctctcccccagcaaattatcttgtataatgtttaaaaacccaaaggccagatctccccttttaacgtgaatcagaaggaggatggcaattggaccaagggcagagtggccacacttgaaacacattataaaatgggaatatatttcagggaaccccacccccacacttccactccacctcacacctgttggtcctgctttgtgggtgattgattgatacccaaggactgccccacctttaaattcctgcaatttatgctgcaaccaacatcttagtgtttgctctctccgggaagaggccaggtgggggagaacatacggtccagagcctgagatcgcctggctggggtgcaggcaagcaggaacccagtctagatagaatgcagtgttctctaaagctatggatggtttcagtgaaatgtctgtgtctgacaatcgtcacgcaagagtacttactgtcttcccttgtacatacattgtctgtgtttagcttttcctagtattgtgaggtttcaaataggggttccatgtaaatactctttctgctactgaaatgccggcccccttgagtatgcatcacccccacagatggttttgcctttctctatgctaacactttttgagccactgacgtgcagatcggtggttagtttcttgggcttttattttgcaattttatatatatacacatattatatatatatatatatttatgggttggttttgtatagttttctgtttgaatctctgagcaccaaagctgccctttgattttcacgagaactttccaaagccacttcctgagccctcctgctgctttggtgtctgacggtgatgctgcggtggcatctctgcccgtgaatttctgtatgtgtgtgctgttacctcacctgcagacatgaccctagtaaatctaacgtgcttggcttccca

SEQ ID NO: 519 - DNA, 3741 bp, Homo sapiens
  ENST00000407644
aaaggtttctggtgatgatgtagcatccgaggctcttaggaaatcggggctgcaagcactggcccctgcttggggatggtgggaccctcgcccggagcgtaacgcctgacagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaa

SEQ ID NO: 520 - DNA, 2654 bp, Homo sapiens
  ENST00000355733
gggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatgagacaggacaggaacgagagccaggctctggtccggccgtgtgcgagttcttcagcgttgccctccacatctggagtaacatattggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaa

SEQ ID NO: 521 - DNA, 475 bp, Homo sapiens
  ENST00000481675
gctcctggctggttctcttcagagacaggacaggaacgagagccaggctctggtccggccgtgtgcgagttcttcagcgttgccctccacatctggagtaacatattggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctc

SEQ ID NO: 522 - DNA, 874 bp, Homo sapiens
  ENST00000522886
gagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatgagacaggacaggaacg

SEQ ID NO: 523 - DNA, 997 bp, Homo sapiens
  ENST00000456320
atgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagtctacagagagccagctgatgtccaagggagacgaggataccaaagacgattcagaggagacggtgcccaaccccttcagccaactcactgaccaggagttggaggagtacaagaaagaggtggagaggaagaaactagaacttgatg

SEQ ID NO: 524 - DNA, 3776 bp, Homo sapiens
  ENST00000413157
gccaggagagctctcatttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccggtagagcagaggctgcccctgactggcggggaaacgtgtttgccttcggggtcttctgtgcctggggctgggttgcaggacccctgagtcctcatacccaccttcccctgtgatcttgggtgccggtgctcttgctgcaaaatggaggccaacctcacaggggtgctgtgaggaccagggaggacaatgtctgatggcccctgtgggcactgggctggagaacagcagcccagcctgcctgcaggagtgatgcggccggcttccgtacctcctgccatggaactccactctgtcctcccttactaccccgtgaagtggggactcataggcttggggctggagactcccaggtgccccaggtgtgcccagccctgagagtctctgacctctgagcctggtatgacatcatccaaccagagctctggaaagatgatcatgtacccatagagaaggggtatatagacaggacccatgctcctacaggatgggaagggacaatattacccacacaaacccacattgagttagaaagtattgtaattgtttttgtgcttgagatagaacagtgttttgtctagtgcttagcaaaaggggtgaagttcagaattctggcatgtgtttgaaatcactgctgctccttgcaaggtagcaatgggcatgacattttccttagcagtaaaaattggggaaatacaggaaatgttcctctctgcagggcaaattgtgatgatgcaatgatttcaggtcaagactgcagcccacagggtgggtgcccattggcaggagaagtgtgaaagttgtatcatcacacttacctccccccaaccccaactcagccaagatggggaacactgaatatcccgcagggtcaagtatagaaatagccatgttctggcgggaggtgagagttcattacaatgagcaacactgttaaaaaaacaaacaaaaatctcccctgccatttataccaagtgctcttctcggagtccctcttcttgggtttttggtcttggattctcggttgactccatgattccctacattaggcctactgtggcctcccttttggaaggggcccaggggcagaagacctggcgggccagggcagggaggactggcagcctccaggctcacctccctttggcttcactctctttgctcctcagcttcagagcactgcatcctcaaaggccaagatgaggatgctgaattaggaaaaaaggctgtggagtctgaattttagttcctatcttgggctagaggggtcaaagaattcctgaagcttatgtaagggccggctggtcagctccctagaaccacgggctccacagaggtggcaaaacccagtgattttgccagtatccctgcagggacctgcggtacaggcaggttgaagatctgagactcaggaaccttggcccctttgtcacttacaactgtgtgtgaaacaggactaacagtttggactgagagcactgaagctgctgtgtgttgtgcatataacttaatgctgtgtgttgtggcttgcactgctgtgggggcggggagggcagtggtggggaatggctggcatgaagcttgcttgagccaatgctatgcttgctgggctttggctgactggctttgggccaccaactgtatttgcatagtgatggcttggaagtgtccatagaagggattgcaataaaggtgtgtcttccttc

SEQ ID NO: 525 - DNA, 2332 bp, Homo sapiens
  ENST00000430656
atttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccggtagagcagaggctgcccctgactggcggggaaacgtgtttgccttcggggtcttctgtgcctggggctgggttgcaggacccctgagtcctcatacccaccttcccctgtgatcttgggtgccggtgctcttgctgcaaaatggaggccaacctcacaggggtgctgtgaggaccagggaggacaatgtctgatggcccctgtgggcactgggctggagaacagcagcccagcctgcctgcaggagtgatgcggccggcttccgtacctcctgccatggaactccactctgtcctcccttactaccccgtgaagtggggactcataggcttggggctggagactcccaggtgccccaggtgtgcccagccctgagagtctctgacctctgag

SEQ ID NO: 526 - DNA, 930 bp, Homo sapiens
  ENST00000415348
tcccttattcaactgtcttcatttattctgtaaaagtagcagcagctcagccctgaccatctcctctctcacttgtgggagtctcatttagggatcgtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatcca

SEQ ID NO: 527 - DNA, 721 bp, Homo sapiens
  ENST00000425976
cggtgcgaggcgggcttggcggggctgggcgcgtcccccggggcctcgcgatcgctggctgcgcggcgctcagccgcagtggccggccgagcaggtgcggcgtcggcagccgcctacattgagatcggggcaaccggcactttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgact

SEQ ID NO: 528 - DNA, 582 bp, Homo sapiens
  ENST00000447731
tttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagagcaccactaacacgaagctcttctgcacatcagactcttaatcaaaggattgggcatatcagaagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggc

SEQ ID NO: 529 - DNA, 582 bp, Homo sapiens
  ENST00000473232
ctcatttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccggaattccaaaggtttttgaaactctgtgccaggaaccagggacaaagatgacatatagtctttcttatatcatacctggctcatcacacgctggtctcctctgatcttcagcatcctgagttccaggagcgaattgcaaacccaccgg

SEQ ID NO: 530 - DNA, 551 bp, Homo sapiens
  ENST00000496178
gtcagcgcgcagggccaggagagctctcatttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggaggtcaagaagcaggacacagccagctcccagagcccagtgcacccttgaaccacaccctgcttccccctggaggtaacaactcaccttccttttatgtttccacctggatgtttgaggttgtgtagatgtggccggcacccttgagagtggagctagggggtgcagactgagcagtgaacagaaggagccttggacagggctgggccagcct

SEQ ID NO: 531 - DNA, 6004 bp, Homo sapiens
  ENST00000607359
atgcgaggccacgggaaccactcgcggctgaaatccagatgtgcttctctgggcaacgtccatcaccaccaggcacagatggcgcacggtgcacactgccgagggggccggacaccacagtcaccagacagccggggcccaaccgctgggggccacacccggggcagatggacgtaccggcccatcgaggccctcatcaacgtcagctttcccggagcaaagggtgggagaacggccgagggcgagccctcatgggcgtgggtcttcagaagtggctatttgcagagacaggctcttcctgggcttcccgtctccacccgagtggctgcctgctggtggcaacaccatccaggcagggactcagggttcttgggacctggatttattgacctgctcagagaggagcccagcggccgtgcagatgggaaggcagctgctcagaaaacagggcgtctttatttgttcccgactttcctaggcaacaaattaccagaggccgccgactcgtttggggaaattgcttctgggaacagtgttatttttacctccgtcttgcaatcctctcacccacctggcaccccaccgcccagcgcacgcaagccaagtcccggagctgccatgctcgtctgtgaggaaacgctggagctgggtgcccagggctgctgggggtccacgagcccccggggccaggccgtgagcttggtcggtgggcccacggccggaggctccaggctgggaggggctggctgcaccatgggcctgctcatggccctccaggccagacgccccagggacggcacctgggctgaccctcgaagatgctccagggctgtggagggctcgggcctcaccagggctgcccttgtgagtccagggccatcgggggtggaggaggacaccaggagggaaggctgcgtgcttgtgggctcctggaggtcgtccacccacagaagccgtgttctgattatcaacacgccctctggcaggaccccctggagccagggctccctcggcagcaccgggcgctacaaccagacccgggcaccaggcagccagcagcaggggctgtgctcggatgcagctctacacgaggattttgtgccggagcctactcctgccttctttcaataccctccacaagccttcagcaaaaccaaggttcgcgacttggggaggggaggcctttatgccttttccaaggaggagaaggtatctgaggcccagcgggtagaggcctacgagacccacggccttggcctgagtacaggccgacagaaccctgtgccgtccccctgtaagcctggatgcgtgtgccagggccttgcgctggacgcagaggcctggccgaggcaccctggacgcaggccctgtgcggccaaggaggcctgcctgggcccacctggctgcagcggggagctgagcctccctgaggaggaaggaatcgcacctggggcagcaacagcagctcctgcctgggtccctcatggccgcgtgagccgcttcctcactgtaaagctcttcacctatgtaactatgtatcaatgtaaacaggaacgtatcctccgcctctgcatctctggtgaatccgggcgatacgtgcggcgctcacgcttccgcaactttgcagcgctcatggtgagtacgggggtcccgggggtcctgcagctgggggctaggccgctgcgggggggcggccacccgtatggggactcccaggctggaaaagttgtggaatggcgagctggtgaccgggcttccgggctcagtgccggggaaagaaggttcctcagccagtcggagctgcagacctggccccggacacctcactgtgtaggaaagaaggttcctcagccagttggagctgcagacctagccccggacacctcactgtgcaggaaagaaggttcctcagccagtcggagctgcagacctggccccggacacctcacccgcagggaggaagattccttcaggcagctggcattccccaggtttgaagaggtcactttcccacctctcactgctgcagaaagagcaccctctgtccacggtggacactctctagccagccagggcctcgtcttggctggacggacaagaagtgtggcctcaggagggaagcaggagctctcgggcccgctggctgcctgcatcccgacacaggatctgaagacagtgctctccctgccccgctacccaggggagttcctgcaccccgtggtgtacgcgtgcacggccgtcatgctgctctgcctcctggcctccttcgtcacctacatcgtgcaccagagcgccatccgcatcagccgcaagggccggcacacgctcctgaatttctgcttccacgcggccctgaccttcactgtgttcgccggcggcatcaatcgcaccaagtaccccatcctgtgccaggcggtgggcatcgtgctgcactattctacactgtccaccatgctgtggataggagtgaccgccaggaacatctacaagcaggtgaccaagaaggcccctctgtgcctggacacagaccagccaccgtaccccaggcagcccctgctcaggttttacctcgtcagcggaggggtcccctttatcatctgtggggtcacggctgccacgaacatcaggaattacgggacagaggacgaggacacggcctgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcacagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccccgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgccccttccttgtgatcacacccctgccccttccttgtgatcacacccctgccccttccttgtgatcacacccctgccccttccttgtgaaagacctcagcggggaaacgctccgggccacgcccactccccttatcccaattccgcgtgctggtcccgcacacggtcatccggtttctgtcctgtggtctccagtcctggggcaccctagaggcagagcaggggattccatcaaaggacccactgagaccccagcatggccctgcccgagatgccctgctgcccacggagtcctggcttcccctggtgtggccgggcagggccgagatcgcaggagggggctgccctgacctttcccagtgttcaatgtgtgtgtcttgcgttctactccgggggtggcggcggcaggtctgtccccagcattctcgctctgggcagaaccctcgggaccctccgctgtcgtgtgtctgagccacccctgcagcttcacagggcccctgcacacctctgcccactcagtgtgccctgtcagccctgtccttgtcgtagccccagccctgcagggctgagagcaccacagatgctgggggctgctctggactttggggatggctgtcagcctcagagggccaatggggggctttcacgggcccaaggcttgggaaaatgcccagacatcctttagtgaagactcgacttccaaaaccagccaccgctgggactggattccactccagtataggcacttagcaacacgaaggtttattccaaaaagaaaaggggctgacagacgggagattctcatggacaaaatccctttccctttttctcgtctccatgaacatctgggtaccaagccctgactcaaaggacagatgtggatgacagcaagacttctgtgaaagcaagtggcccgtccctaggtgggagggagtccagagggtcatgggtgtgaaactgtgcacagctttccctccctccctcttcctccttgtctgtgacacatgtgcacccacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctgtgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtttgttctttgtgaggctggttaatagcatccccgtgtgtttttctcaccctcgatggggtagaggggcacctgaatgtgtggcccccgtctgtgtcctggatcctggggcagggctgctctccctggcccctgcagcccctcatgaactttccaccctcagtgcccccggctgagcagagaggcgtcccaccattcaaccaaagaaagtcaacattgaacattaaacctctgtgtgtttctatactga

SEQ ID NO: 532 - DNA, 4283 bp, Homo sapiens
  ENST00000392607
gtcgccgcgggaggtgcgcgcagaggcggcggcgctgctggccgggctgggccgctcgtgcgcggggctgtgactcaccggccggcgccgcagccccgcaatctgttgataactcggtcccagctcggccgctgccctcgcgaatggagagcgggtccccggcggggggagcgcagcgcgtctgtctccgggagcgcggcccggccgccccggcagccgcttcggccacagcagatgggagcagctcccggactgcgcccgccccgccgcggtcaccctgaggccaggggcccgggagcgcgacctcctggccgccgtctgggactttgaccttccagaggccatggaggctggcggggagcagggcgccacctgatcgcctccccctggacgcctcctccagcggcgctcacgcttccgcaactttgcagcgctcatggatctgaagacagtgctctccctgccccgctacccaggggagttcctgcaccccgtggtgtacgcgtgcacggccgtcatgctgctctgcctcctggcctccttcgtcacctacatcgtgcaccagagcgccatccgcatcagccgcaagggccggcacacgctcctgaatttctgcttccacgcggccctgaccttcactgtgttcgccggcggcatcaatcgcaccaagtaccccatcctgtgccaggcggtgggcatcgtgctgcactattctacactgtccaccatgctgtggataggagtgaccgccaggaacatctacaagcaggtgaccaagaaggcccctctgtgcctggacacagaccagccaccgtaccccaggcagcccctgctcaggttttacctcgtcagcggaggggtcccctttatcatctgtggggtcacggctgccacgaacatcaggaattacgggacagaggacgaggacacggcgtactgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcacagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccccgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgccccttccttgtgatcacacccctgccccttccttgtgatcacacccctgccccttccttgtgatcacacccctgccccttccttgtgaaagacctcagcggggaaacgctccgggccacgcccactccccttatcccaattccgcgtgctggtcccgcacacggtcatccggtttctgtcctgtggtctccagtcctggggcaccctagaggcagagcaggggattccatcaaaggacccactgagaccccagcatggccctgcccgagatgccctgctgcccacggagtcctggcttcccctggtgtggccgggcagggccgagatcgcaggagggggctgccctgacctttcccagtgttcaatgtgtgtgtcttgcgttctactccgggggtggcggcggcaggtctgtccccagcattctcgctctgggcagaaccctcgggaccctccgctgtcgtgtgtctgagccacccctgcagcttcacagggcccctgcacacctctgcccactcagtgtgccctgtcagccctgtccttgtcgtagccccagccctgcagggctgagagcaccacagatgctgggggctgctctggactttggggatggctgtcagcctcagagggccaatggggggctttcacgggcccaaggcttgggaaaatgcccagacatcctttagtgaagactcgacttccaaaaccagccaccgctgggactggattccactccagtataggcacttagcaacacgaaggtttattccaaaaagaaaaggggctgacagacgggagattctcatggacaaaatccctttccctttttctcgtctccatgaacatctgggtaccaagccctgactcaaaggacagatgtggatgacagcaagacttctgtgaaagcaagtggcccgtccctaggtgggagggagtccagagggtcatgggtgtgaaactgtgcacagctttccctccctccctcttcctccttgtctgtgacacatgtgcacccacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctgtgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtttgttctttgtgaggctggttaatagcatccccgtgtgtttttctcaccctcgatggggtagaggggcacctgaatgtgtggcccccgtctgtgtcctggatcctggggcagggctgctctccctggcccctgcagcccctcatgaactttccaccctcagtgcccccggctgagcagagaggcgtcccaccattcaaccaaagaaagtcaacattgaacattaaacctctgtgtgtttctatactga

SEQ ID NO: 533 - DNA, 3438 bp, Homo sapiens
  ENST00000392606
cccgtggggggctcatcctacccacagtaagagcatcctggcgtgaccccactgaggacttcacctcctctcccttggtggacacctatccaggtgggcatcgtgctgcactattctacactgtccaccatgctgtggataggagtgaccgccaggaacatctacaagcaggtgaccaagaaggcccctctgtgcctggacacagaccagccaccgtaccccaggcagcccctgctcaggttttacctcgtcagcggaggggtcccctttatcatctgtggggtcacggctgccacgaacatcaggaattacgggacagaggacgaggacacggcgtactgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcacagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccccgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgccccttccttgtgatcacacccctgccccttccttgtgatcacacccctgccccttccttgtgatcacacccctgccccttccttgtgaaagacctcagcggggaaacgctccgggccacgcccactccccttatcccaattccgcgtgctggtcccgcacacggtcatccggtttctgtcctgtggtctccagtcctggggcaccctagaggcagagcaggggattccatcaaaggacccactgagaccccagcatggccctgcccgagatgccctgctgcccacggagtcctggcttcccctggtgtggccgggcagggccgagatcgcaggagggggctgccctgacctttcccagtgttcaatgtgtgtgtcttgcgttctactccgggggtggcggcggcaggtctgtccccagcattctcgctctgggcagaaccctcgggaccctccgctgtcgtgtgtctgagccacccctgcagcttcacagggcccctgcacacctctgcccactcagtgtgccctgtcagccctgtccttgtcgtagccccagccctgcagggctgagagcaccacagatgctgggggctgctctggactttggggatggctgtcagcctcagagggccaatggggggctttcacgggcccaaggcttgggaaaatgcccagacatcctttagtgaagactcgacttccaaaaccagccaccgctgggactggattccactccagtataggcacttagcaacacgaaggtttattccaaaaagaaaaggggctgacagacgggagattctcatggacaaaatccctttccctttttctcgtctccatgaacatctgggtaccaagccctgactcaaaggacagatgtggatgacagcaagacttctgtgaaagcaagtggcccgtccctaggtgggagggagtccagagggtcatgggtgtgaaactgtgcacagctttccctccctccctcttcctccttgtctgtgacacatgtgcacccacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctgtgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtt

SEQ ID NO: 534 - DNA, 682 bp, Homo sapiens
  ENST00000511051
ttcatattttcctaacctgtgtggtctttgtgggaggaataacccagactaggaatgccagcatctgccaagcagttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcagcagcgaacattaagaattacggcagtcggccaaacgcaccctagctgtacagcagtcatgacgctggcatctgcttggcttctggggagccctcgggaaacttacaatcatggcagaaggtgaaggagaagcagtgtccattctccagtatggttttgggggagtatggcttcctacctactgcggaccacctgtcaactctgggctgtaacatgagagaattgtgaacttctgtcttgtttgagccatggtttcattctctttttcagccatgtagcctgtgctgtaactcagtgccacattagcaactagtgaaagtcaatgtgggtaaatttgtcattcttcaggttagaacatttcttccttttattcttgtgtttttggctaaataaactgggaaattatagta

SEQ ID NO: 535 - DNA, 4566 bp, Homo sapiens
  ENST00000334304
ggcggcggcagaggaggaggaggaggcggtgctcgcgccgggcggtagagcggcgctgggacccatgcggccgtgacccccggctccctagaggcccagcgcagccgcagcggacaaaggagcatgtccgcgccggggaaggcccgtcctccggccgccataaggctccggtcgccgctgggcccgcgccgcgctcctgcccgcccgggctccggggcggcccgctaggccagtgcgccgccgctcgccccgcaggccccggcccgcagcatggagccacccggacgccggcggggccgcgcgcagccgccgctgttgctgccgctctcgctgttagcgctgctcgcgctgctgggaggcggcggcggcggcggcgccgcggcgctgcccgccggctgcaagcacgatgggcggccccgaggggctggcagggcggcgggcgccgccgagggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaagaatactattgtggaggcttctattcagcttcctccttcccttttctcaccaaagcaaaaaagagaactcagaccaactgatgactctctttacaagcttcaactcattgcattccgcaatggaaagctttttccagccactggaaattcaacaaatttggctgatgatggaaaacgacgtactgtggttacccctgtgattctcaccaaaatagatggtgtgaatgtagatacccaccacatccctgttaatgtgacactgcgtcgaattgcacatggagcagatgctgttgcagcccggtgggatttcgatttgctgaacggacaaggaggctggaagtcagatgggtgccatatactctattcagatgaaaatatcactacgattcagtgctactcccttagtaactatgcagttttaatggatttgacgggatctgaactatacacccaggcggccagcctcctgcatcctgtggtttatactaccgctatcattctcctcttatgtctcttagccgtcattgtcagttacatataccatcacagtttgattagaatcagcctcaagagctggcacatgcttgtgaacttgtgctttcatattttcctaacctgtgtggtctttgtgggaggaataacccagactaggaatgccagcatctgccaagcagttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcagcagcgaacattaagaattacggcagtcggccaaacgcaccctattgctggatggcatgggaaccctccttgggagccttctatgggccagccagcttcatcacttttgtaaactgcatgtactttctgagcatatttattcagttgaaaagacaccctgagcgcaaatatgagcttaaggagcccacggaggagcaacagagattggcagccaatgaaaatggcgaaataaatcatcaggattcaatgtctttgtctctgatttctacatcagccttggaaaatgagcacacttttcattctcagctcttgggggccagccttactttgctcttatatgttgcactgtggatgtttggggctttggctgtttctttgtattaccctttggacttggtttttagcttcgtttttggagccacaagtttaagcttcagtgcgttcttcgtggtccaccattgtgttaatagggaggatgttagacttgcgtggatcatgacttgctgcccaggacggagctcgtattcagtgcaagtcaacgtccagccccccaactctaatgggacgaatggagaggcacccaaatgccccaatagcagtgcggagtcttcatgcacaaacaaaagtgcttcaagcttcaaaaattcctcccagggctgcaaattaacaaacttgcaggcggctgcagctcagtgccatgccaattctttacctttgaactccacccctcagcttgataatagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaactttgaagttttggattttacttatttttatccccaaattgttgctattttttaggatctgaaacaaaatctttctaaaacattgttttagttgtcaaagcaccaacaggacattttgggatgtgaaatgtaatttcttggaatctgtaatttgtacttaatatttcaggcttgtatttaatataataaataggtgtttgttattgtgtcg

SEQ ID NO: 536 - DNA, 3968 bp, Homo sapiens
  ENST00000499527
tgtcatcatacccctaaaattccactattggtaataatcaggcttcagtatctttaagagtaaacctcctctggaaatttagaaatgccatagaaaacacttcagtgcctaaagatgtgttttgtcccctgtagaaaattctttgtttgacacctcctatgtgggagttgcctttaacctgtatttttacttttgtattttagagccctacctcattcttttgacctttgtgtcagagacacctccagcaatagtagagttgaccattttgagtcagcatctgatttgttttgaatttattggtttctatgcatcaaattcatttatactatttttacttacagtatttggtgtgacttgatagctcaaaagggttattttatgctttctgttccacttctgtctataaattttgctttcacagcgcagtcagcaaaactaatgggaaccatgaagccacttttctttttaagacgatcatttctgacgtttgtagttgggccaaacttgatcccacctcccagcacctcagagccactgcaaggtttatctggagaggggccaccctggctttctcctgcaaaagaagatttgggctttcaggtcaccaagtgtttgctgcagattggttctcattaaaataaactctggacagtggtccataattttattatcgacctttgattttcttgaggttggagaggcatccctttagaatgacagattttttcttggaatttcataattatataaaaaagcagtgattaaaaaaaagcaagttactggttaagaaagctggattatgtccttgatactccagtgacatatgacatttacttttcttaaactaaaatttaagcttctctcatttcctcacatcttcatctagaatttcatcctcaactagagttgcttcatgtataggtcatgtgataaatagaaactgtaagtgtatcatttgcatatattgcagttatcctatacttactgagcacctattatatcccatgaattgtgtccattcaattcctacgaaacccctagaggtggcgattgataattttctactattaaattgaggaaagttaatttcagagaggtcgcattatttcctcaaaatcacattcttaataagtaataatatagtgatttctactaattgcttgtcacacactaggcgatttgctaaatgcttaatgtggaccatcttacttaacctcacagtacttttatattactcttggttcccaagtgaggaagccagcactttaggtcttacgtgactttgctcagatcacccagcaggtaagaggtgaataccagtttaaaaatcaaggaaaatttcatttctgagttcaccctcttaaccatcaatatattattatattgctttgtgattgttacagtgtataaaagctctgaatcatatctcaggtctcttactctggaacttattctgtgtgtgctgtggccttcaccctgtagttaacctgtgccctctgtatattcctccttaaaaagaatgttagaaaatggactctaggccgggcatggtggctcatgcctgtaatcccagcacttttggaggctgaggtggatggatcacctgaggtcaggagttggagaccagcctggccaacatggcaaaaccctctctctactaaaaatacaaaaattagccaggcgtggtggtgcgtacctgtagtcccagctactcaggaggctgaggcaggagaatcacttgaacccaggaggcagaggttgcagtgagccgagatcacactgcagcactctatcctgggtgacagagcgaggctctgtcccaaaaaaaaaaaaaaaagaaaatgaactctaatgtataatgtcacatctatgaaaaacacacttttggtttaatgtctgggagccagttctgtcctgtattaagggtcgtctttggtataaatggtagtttgtgggcttcctagagccaattgttggtttgtgtatttgaggattgtgattccctgtcacatgtctattagaacacagtgttgccttagcaggcaacagagttgattattaggataggccttcctgctgctttcaaatcagacttctgagttacttaccaattttgaggtaagccttagtaggaacattttttttcttttatttattctttgatcttccttgtaggttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcagcagcgaacattaagaattacggcagtcggccaaacgcaccctattgctggatggcatgggaaccctccttgggagccttctatgggccagccagcttcatcacttttgtaaactgcatgtactttctgagcatatttattcagttgaaaagacaccctgagcgcaaatatgagcttaaggagcccacggaggagcaacagagattggcagccaatgaaaatggcgaaataaatcatcaggattcaatgtctttgtctctgatttctacatcagccttggaaaatgagcacacttttcattctcagctcttgggggccagccttactttgctcttatatgttgcactgtggatgtttggggctttggctgtttctttgtattaccctttggacttggtttttagcttcgtttttggagccacaagtttaagcttcagtgcgttcttcgtggtccaccattgtgttaatagggaggatgttagacttgcgtggatcatgacttgctgcccaggacggagctcgtattcagtgcaagtcaacgtccagccccccaactctaatgggacgaatggagaggcacccaaatgccccaatagcagtgcggagtcttcatgcacaaacaaaagtgcttcaagcttcaaaaattcctcccagggctgcaaattaacaaacttgcaggcggctgcagctcagtgccatgccaattctttacctttgaactccacccctcagcttgataatagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaactttgaagttttggattttacttatttttatccccaaattgttgctattttttaggatctgaaacaaaatctttctaaaacattgttttagttgtcaaagcaccaacaggacattttgggatgtgaaatgtaatttcttggaatctgtaatttgtacttaatatttcaggcttgtatttaatataa

SEQ ID NO: 537 - DNA, 3534 bp, Homo sapiens
  ENST00000282943
atgatgcgagtcatgccatgccaggtggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaagcaaaaaagagaactcagaccaactgatgactctctttacaagcttcaactcattgcattccgcaatggaaagctttttccagccactggaaattcaacaaatttggctgatgatggaaaacgacgtactgtggttacccctgtgattctcaccaaaatagatggtgtgaatgtagatacccaccacatccctgttaatgtgacactgcgtcgaattgcacatggagcagatgctgttgcagcccggtgggatttcgatttgctgaacggacaaggaggctggaagtcagatgggtgccatatactctattcagatgaaaatatcactacgattcagtgctactcccttagtaactatgcagttttaatggatttgacgggatctgaactatacacccaggcggccagcctcctgcatcctgtggtttatactaccgctatcattctcctcttatgtctcttagccgtcattgtcagttacatataccatcacagtttgattagaatcagcctcaagagctggcacatgcttgtgaacttgtgctttcatattttcctaacctgtgtggtctttgtgggaggaataacccagactaggaatgccagcatctgccaagcagttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcagcagcgaacattaagaattacggcagtcggccaaacgcaccctattgctggatggcatgggaaccctccttgggagccttctatgggccagccagcttcatcacttttgtaaactgcatgtactttctgagcatatttattcagttgaaaagacaccctgagcgcaaatatgagcttaaggagcccacggaggagcaacagagattggcagccaatgaaaatggcgaaataaatcatcaggattcaatgtctttgtctctgatttctacatcagccttggaaaatgagcacacttttcattctcagctcttgggggccagccttactttgctcttatatgttgcactgtggatgtttggggctttggctgtttctttgtattaccctttggacttggtttttagcttcgtttttggagccacaagtttaagcttcagtgcgttcttcgtggtccaccattgtgttaatagggaggatgttagacttgcgtggatcatgacttgctgcccaggacggagctcgtattcagtgcaagtcaacgtccagccccccaactctaatgggacgaatggagaggcacccaaatgccccaatagcagtgcggagtcttcatgcacaaacaaaagtgcttcaagcttcaaaaattcctcccagggctgcaaattaacaaacttgcaggcggctgcagctcagtgccatgccaattctttacctttgaactccacccctcagcttgataatagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtg

SEQ ID NO: 538 - DNA, 280 bp, Homo sapiens
  ENST00000504617
ttgcagcccggtgggatttcgatttgctgaacggacaaggaggctggaagtcagatgggtgccatatactctattcagatgaaaatatcactacgattcagtgctactcccttagtaactatgcagttttaatggttgggataattcttcactattccacccttgccacagtactatgggtaggagtgacagctcgaaatatctacaaacaagtcactaaaaaagctaaaagatgccaggatcctgatgaaccaccacctccaccaagaccaatgctcag

SEQ ID NO: 539 - DNA, 671 bp, Homo sapiens
  ENST00000506155
gaaaattaactttgttaatttgaaacacttttcttgtttacttatttaactctttaaagtttgcatttctgttttatacttcttttaatctatgttatgtggtgttgacatttcgcttgactgatgatttttttaactgttaaattttgtatatccaatttaaaaaatgaagtcaacctaattataccacttttgtaactatctgacatatttttttctggtttctatgtactaatgtagtgagctttttttatgtatatatattttttcagaatactattgtggaggcttctattcagcttcctccttcccttttctcaccaaagcaaaaaagagaactcagaccaactgatgactctctttacaagcttcaactcattgcattccgcaatggaaagctttttccagccactggaaattcaacaaatttggctgatgatggaaaacgacgtactgtggttacccctgtgattctcaccaaaatagatggtgtgaatgtagatacccaccacatccctgttaatgtgacactgcgtcgaattgcacatggagcagatgctgttgcagcccggtgggatttcgatttgctgaacggacaaggaggctggaagtcagatgggtgccatatactctattcagatgaaaatatcactacgattcagtgctactcc

SEQ ID NO: 540 - DNA, 1572 bp, Homo sapiens
  ENST00000508133
atttctgtaatcatctgatactcttaggatgccactgaagaggaataactctaaataccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaaggggaaattccggtgaatatggaattagaagaagagaggttagaagccaagaaaaagattgtacaataaattcttcaactatggaatgtttttagatggttaattgttcacttctttggtatatatatattttttactgaatgctgaataatttgttatttaaaaatcctcaataaagaaatctgaaaaaattcagtgatcagtcagcattttcagttgttcctatgtgttattattttttttttctaaatgtgtttcctagtctcaaggaaatttctgctaagtgtactgaatctaaacctctattatgtttgtataatttcattcttttgttgtgtggaggtttgaattcatcataaatcaccttaaagttccataagcccaaattaattatactcatatttatgatatgct

SEQ ID NO: 541 - DNA, 2870 bp, Homo sapiens
  ENST00000502482
gggacccatgcggccgtgacccccggctccctagaggcccagcgcagccgcagcggacaaaggagcatgtccgcgccggggaaggcccgtcctccggccgccataaggctccggtcgccgctgggcccgcgccgcgctcctgcccgcccgggctccggggcggcccgctaggccagtgcgccgccgctcgccccgcaggccccggcccgcagcatggagccacccggacgccggcggggccgcgcgcagccgccgctgttgctgccgctctcgctgttagcgctgctcgcgctgctgggaggcggcggcggcggcggcgccgcggcgctgcccgccggctgcaagcacgatgggcggccccgaggggctggcagggcggcgggcgccgccgagggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaaggtatgttacattctgcaatcatttaagactatttacagttaaattagaatgctccaaatgttctgcttcgcaaaataaccttattaaaagattttttttttgcaggaagataggtattattgcttttgctactgttttaaagaaaactaaccaggaagaactgcattacgactttcaagggccctaggcatttttgcctttgattccctttcttcacataaaaatatcagaaattacattttataactgcagtggtataaatgcaaatatactattgttacatgtgaaaaaatcttatttgacttaaaagtttatttatttgtttttttgctcctgattttaagacaataagatgttttcatgggcccctaaaagtatcatgagcctttggcactgcgcctgccaagcctagtggagaagtcaaccctgagaccaggtgtttaatcaagcaagctgtatatcaaaatttttggcagaaaacacaaatatgtcatatatctttttttaaaaaaagtatttcattgaagcaagcaaaatgaaagcatttttactgatttttaaaattggtgctttagatatatttgactacactgtattgaagcaaatagaggaggcacaactccagcaccctaatggaaccacatttttttcacttagctttctgtgggcatgtgtaattgtattctctgcggtttttaatctcacagtactttatttctgtcttgtccctcaataatatcacaaacaatattccagtcattttaatggctgcataataactgatccaacaggtgttaggtgttctggtttagtgtgagcactcaataaatattgaatgaatgaacgaa

SEQ ID NO: 542 - DNA, 733 bp, Homo sapiens
  ENST00000514129
gagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccagaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttc

SEQ ID NO: 543 - DNA, 554 bp, Homo sapiens
  ENST00000506133
ggctcattttctgggttaagtctccttgaaagattggacctccgaaacaatcttattagtagtatagatccaggtgccttctggggactgtcatctctaaaaagattaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaag

SEQ ID NO: 544 - DNA, 538 bp, Homo sapiens
  ENST00000513385
aaaaagaatcaaggcagccactatacaaacatgaatgcaaggaccgcagcatgatctatgaaaacacttaaagtatggttttaaatgtaacccaaattcagcaggagtatacacaggattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacag

SEQ ID NO: 545 - DNA, 485 bp, Homo sapiens
  ENST00000514749
cagcataagcgatgtaccaaactaaaacttggtactgtgttaaatggtagcagtagacatcaaggacttccttaatggcgttgaaattcaagaggcgagagctccaagtagcgttcctaagcatcgtccatagatcatgtggcgcttttatgactgaggaaatgacagtcctttggccgaagcattctggaattgcagattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtcttt

SEQ ID NO: 546 - DNA, 453 bp, Homo sapiens
  ENST00000506346
gcggcggcggcggcggcgccgcggcgctgcccgccggctgcaagcacgatgggcggccccgaggggctggcagggcggcgggcgccgccgagggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattgctgtacaggaagcatggagctggcatctgctcggcttctaaggaggcctcaggaagcttacaatcatggtggaaggccaaacttgcatgtcacatggcgaaaacagaagcgaggatgtgatgtcaaggggaaaaacactagtataaactttgatattttattcagatgtctttaaatgtgatatatttgtaaatatatatttttcttagca

SEQ ID NO: 547 - DNA, 563 bp, Homo sapiens
  ENST00000565587
aaaatgagatggttggtgaccccagaggacaaacctgggttgtgctttctgagccatctcctggtgctgagcacttggaccgcttcagctctccacgggtcaggctggacagccctgtgaccacagcttgtcactggagtgtcttttcttcagggcccctcttgagtaggaggagaccaggctttgaaggttcctgagaggagatgtacgggacctgaatacagctttcctgacctgcccctcataggagcctgcagggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacc

SEQ ID NO: 548 - DNA, 590 bp, Homo sapiens
  ENST00000568791
attccaggcggggcctggactgagggaggaggcaggaagaaactcacaaagagttggcagatcacggatggagggcagcatctcccaacagcctgggcggccgctgagacccagagaacccaaggactcccctgggctcatccagcagcctctgcttcccaggagagaggtgctgaagtccacgaagagacagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatcc

SEQ ID NO: 549 - DNA, 553 bp, Homo sapiens
  ENST00000570044
ttccaggcggggcctggactgagggaggaggcaggaagaaactcacaaagagttggcagatcacggatggagggcagcatctcccaacagcctgggcggccgctgagacccagagaacccaaggactcccctgggctcatccagcagcctctgcttcccaggagagaggtgctgaagtccacgaagagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgccccttt

SEQ ID NO: 550 - DNA, 574 bp, Homo sapiens
  ENST00000567553
aactcacaaagagttggcagatcacggatggagggcagcatctcccaacagcctgggcggccgctgagacccagagaacccaaggactcccctgggctcatccagcagcctctgcttcccaggagagaggtgctgaagtccacgaagagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccagggg

SEQ ID NO: 551 - DNA, 602 bp, Homo sapiens
  ENST00000565314
cacaaagagttggcagatcacggatggagggcagcatctcccaacagcctgggcggccgctgagacccagagaacccaaggactcccctgggctcatccagcagcctctgcttcccaggagagaggtgctgaagtccacgaagaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcac

SEQ ID NO: 552 - DNA, 841 bp, Homo sapiens
  ENST00000564912
acaaagagttggcagatcacggatggagggcagcatctcccaacagcctgggcggccgctgagacccagagaacccaaggactcccctgggctcatccagcagcctctgcttcccaggagagaggtgctgaagtccacgaagaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccattgcagagcctggagtcgaaactgacctctgtgagattcatg

SEQ ID NO: 553 - DNA, 548 bp, Homo sapiens
  ENST00000562673
aaagagttggcagatcacggatggagggcagcatctcccaacagcctgggcggccgctgagacccagagaacccaaggactcccctgggctcatccagcagcctctgcttcccaggagagaggtgctgaagtccacgaagagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgg

SEQ ID NO: 554 - DNA, 3655 bp, Homo sapiens
  ENST00000564907
agatcacggatggagggcagcatctcccaacagcctgggcggccgctgagacccagagaacccaaggactcccctgggctcatccagcagcctctgcttcccaggagagaggtgctgaagtccacgaagaggtggtgacttccaagagtgactccgtcggaggaaaatgactccccagtcgctgctgcagacgacactgttcctgctgagtctgctcttcctggtccaaggcagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactgg

SEQ ID NO: 555 - DNA, 3852 bp, Homo sapiens
  ENST00000568908
aacaagagagggtggcggctgcagtggctgtggggcagccggaaatggggcgagacagacaggcggagcctcacctggggctgcccgccagcccagacaagctcagactgggtgcctgtggccctgggaggaggtggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacct

SEQ ID NO: 556 - DNA, 4254 bp, Homo sapiens
  ENST00000568909
agacaggcggagcctcacctggggctgcccgccagcccagacaagctcagactgggtgcctgtggccctgggaggaggtggaaggggaggagcaggccacacaggcacaggccggtgagggacctgcccagacctggaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactggcgtaagcattttgggtcatttccttctgagctttttcctgtgcttctattgaaagagtcactgatactaatacaaataccttggggccaatcaggaaacatgaaagagagaagagggctgtgtgtgaagaaaaaaaaaaaatcgactgctggaaacctcatcaaccagggcacaggggaagataaatggcaacttggtgtctgtgctggggaggcaatggggagtggtggggcctgtggcgaactggagactcccaaccccatgctgagagcgtggctgctcatcagctccagctggtcactaccttgcagggatgagggcccatgtagccagaccacctgccttttatgagaaatgggaaatccagactgtggtttgacatcccctgattttaaaattttggcgaatccaaaacattttctggccaaagagattacagtcaaaagctgcctggtcctgggatttatgcaaccagtttactgatcactctgcagcaggtgggctgcaagaattaaatcactggacttctctcccatccctgcctttaa

SEQ ID NO: 557 - DNA, 555 bp, Homo sapiens
  ENST00000566778
cagactgggtgcctgtggccctgggaggaggtggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctg

SEQ ID NO: 558 - DNA, 533 bp, Homo sapiens
  ENST00000562101
agactgggtgcctgtggccctgggaggaggtggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttctt

SEQ ID NO: 559 - DNA, 534 bp, Homo sapiens
  ENST00000561872
agactgggtgcctgtggccctgggaggaggtggaaggggaggagcaggccacacaggcacaggccggtgagggacctgcccagacctggaggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcc

SEQ ID NO: 560 - DNA, 1016 bp, Homo sapiens
  ENST00000561988
agactgggtgcctgtggccctgggaggaggtggaaggggaggagcaggccacacaggcacaggccggtgagggacctgcccagacctggagacagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggag

SEQ ID NO: 561 - DNA, 3741 bp, Homo sapiens
  ENST00000567835
ggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 562 - DNA, 563 bp, Homo sapiens
  ENST00000569372
acacaggcacaggccggtgagggacctgcccagacctggaggagcgacgatgcctcactgcctgaccagaggcacctgacaccaggcctggcatccgagcagctgccactcagacctcacaggccagggccaagggagctgctgatgcaagaggcacaattttaggggcaagagcagcaagtaggatggtcttgaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttctt

SEQ ID NO: 563 - DNA, 571 bp, Homo sapiens
  ENST00000563548
acacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctg

SEQ ID NO: 564 - DNA, 507 bp, Homo sapiens
  ENST00000562003
acaggccggtgagggacctgcccagacctggaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacct

SEQ ID NO: 565 - DNA, 937 bp, Homo sapiens
  ENST00000561833
gcttgtcttctctgggccaggcccctccatggtggctgaggactctttggaacagggaactgtcgtggaagaaagggcccggccctgccactgcctcctgtgggaccctgggccaggctcccctgctgtccaggcctgtttccctgtctgttccatgaaggagaggcaggggcagtggtctgtaaacccataagctgcagcagtaggcccctcccctggtctcatgggccacacacgccagccagccagagctcttcattttaccaagagagaagtggtggcagtcctggtgtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccaca

SEQ ID NO: 566 - DNA, 451 bp, Homo sapiens
  ENST00000569531
agtttcaactgcagctcttcattttaccaagagagaagtggtggcagtcctggtgtccaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcct

SEQ ID NO: 567 - DNA, 567 bp, Homo sapiens
  ENST00000565013
aatcatctatcctcattgctcggaggaggagggcagacaggagcctctgcagggagtggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctc

SEQ ID NO: 568 - DNA, 594 bp, Homo sapiens
  ENST00000561696
aatcatctatcctcattgctcggaggaggagggcagacaggagcctctgcagggagtgtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacgg

SEQ ID NO: 569 - DNA, 487 bp, Homo sapiens
  ENST00000562414
agttgtcgccctgacctggggggtgggcggacagcatccaagggccctgttgccgtggcaaccccggcctctctgtgggaactttggggagactggccctgggaggcgacagatggaggctgaggaagcagagtgatccccggccccttcctgtccctgaacactgtctgcctggatgaggggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacaca

SEQ ID NO: 570 - DNA, 622 bp, Homo sapiens
  ENST00000561969
gtgggaactttggggagactggccctgggaggcgacagatggaggctgaggaagcagagtgatccccggccccttcctgtccctgaacactgtctgcctggatgaggggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctc

SEQ ID NO: 571 - DNA, 536 bp, Homo sapiens
  ENST00000568487
gaactttggggagactggccctgggaggcgacagatggaggctgaggaagcagagtgatccccggccccttcctgtccctgaacactgtctgcctggatgaggggtgaggctgaggtgcccccttgcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtg

SEQ ID NO: 572 - DNA, 4042 bp, Homo sapiens
  ENST00000562631
actttggggagactggccctgggaggcgacagatggaggctgaggaagcagagtgatccccggccccttcctgtccctgaacactgtctgcctggatgaggggtgaggctgaggtgcccccttgcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 573 - DNA, 592 bp, Homo sapiens
  ENST00000563445
tttggggagactggccctgggaggcgacagatggaggctgaggaagcagagtgatccccggccccttcctgtccctgaacactgtctgcctggatgagggggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagt

SEQ ID NO: 574 - DNA, 545 bp, Homo sapiens
  ENST00000562608
ctgggaggcgacagatggaggctgaggaagcagagtgatccccggccccttcctgtccctgaacactgtctgcctggatgaggggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagct

SEQ ID NO: 575 - DNA, 560 bp, Homo sapiens
  ENST00000565338
agatggaggctgaggaagcagagtgatccccggccccttcctgtccctgaacactgtctgcctggatgagggctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatct

SEQ ID NO: 576 - DNA, 593 bp, Homo sapiens
  ENST00000567702
atggaggctgaggaagcagagtgatccccggccccttcctgtccctgaacactgtctgcctggatgagggctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagc

SEQ ID NO: 577 - DNA, 690 bp, Homo sapiens
  ENST00000567154
cacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtacccaaacaagggctggacagcaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcc

SEQ ID NO: 578 - DNA, 3925 bp, Homo sapiens
  ENST00000388813
agggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtacccaaacaagggctggacagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaa

SEQ ID NO: 579 - DNA, 804 bp, Homo sapiens
  ENST00000563007
gggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcc

SEQ ID NO: 580 - DNA, 3858 bp, Homo sapiens
  ENST00000562558
aaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagc

SEQ ID NO: 581 - DNA, 944 bp, Homo sapiens
  ENST00000566271
aacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccc

SEQ ID NO: 582 - DNA, 896 bp, Homo sapiens
  ENST00000568645
aaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaa

SEQ ID NO: 583 - DNA, 568 bp, Homo sapiens
  ENST00000563374
ctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgctt

SEQ ID NO: 584 - DNA, 640 bp, Homo sapiens
  ENST00000568234
actagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgt

SEQ ID NO: 585 - DNA, 591 bp, Homo sapiens
  ENST00000565770
agctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcccctgccacggggtcccatctgcagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctg

SEQ ID NO: 586 - DNA, 547 bp, Homo sapiens
  ENST00000564338
agctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgactt

SEQ ID NO: 587 - DNA, 594 bp, Homo sapiens
  ENST00000566164
agctgtctgccctgccctgccgtaggagatgggctgggagcctcccacgctctccagctcactcggcaggcagcggggaccagggctggcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcct

SEQ ID NO: 588 - DNA, 565 bp, Homo sapiens
  ENST00000567397
agctcactcggcaggcagcggggaccagggctggcaggttaagcctctgggggtggatcctgaaaggtggtccagccgcctggccctgcgtgggaccctccacctggcagcagacagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctact

SEQ ID NO: 589 - DNA, 551 bp, Homo sapiens
  ENST00000568979
agctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcag

SEQ ID NO: 590 - DNA, 593 bp, Homo sapiens
  ENST00000569992
ttgttgctggagaaactgaggctcagagtggtacagtcactgggcccagcaagctggggtctgctctttaggctgtgagatcagtgctcctactacacagatgggagaaccgaggctctgggagggcaggtggcttgcccaaggtcacctagcacatccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagc

SEQ ID NO: 591 - DNA, 579 bp, Homo sapiens
  ENST00000566123
gtctctggctgctgggttaaggctcaagcttgggagcagcttcacgtgtgagggagacgagggggaggtggcgcccagtcgaggggaaggacaggagagaggtggcagagctgcagcagggttggtgtaggggttggcctcctggcaaggcccagcatgacaaaggcagacagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgacccca

SEQ ID NO: 592 - DNA, 478 bp, Homo sapiens
  ENST00000562682
agtcgaggggaaggacaggagagaggtggcagagctgcagcagggttggtgtaggggttggcctcctggcaaggcccagcatgacaaaggcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgctt

SEQ ID NO: 593 - DNA, 582 bp, Homo sapiens
  ENST00000561782
gtaggggttggcctcctggcaaggcccagcatgacaaaggcaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagt

SEQ ID NO: 594 - DNA, 548 bp, Homo sapiens
  ENST00000564783
acttgggaacaggacaagttacggagccacgttgctttgctgggtctgagccggggtgtgacgtagtccctgcagctgccaacggttgccagggcaacggttgccaggggctgctgtcacctgcgccccttctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgc

SEQ ID NO: 595 - DNA, 576 bp, Homo sapiens
  ENST00000564729
cacctgcgccccttctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcg

SEQ ID NO: 596 - DNA, 575 bp, Homo sapiens
  ENST00000565976
acctgcgccccttctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactgg

SEQ ID NO: 597 - DNA, 720 bp, Homo sapiens
  ENST00000566888
acctgcgccccttctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccaggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagctt

SEQ ID NO: 598 - DNA, 315 bp, Homo sapiens
  ENST00000562804
tctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagacagggtctcgctctgtcacacaggctggagtgcagtggtgtgatcttggctcatcgtaacctccacct

SEQ ID NO: 599 - DNA, 572 bp, Homo sapiens
  ENST00000566508
tctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccaggtggtgacttccaagagtgactccgtcggaggaaaatgactccccagtcgctgctgcagacgacactgttcctgctgagtctgctcttcctggtccaaggcagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgc

SEQ ID NO: 600 - DNA, 2688 bp, Homo sapiens
  ENST00000565539
tctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccaggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctg

SEQ ID NO: 601 - DNA, 618 bp, Homo sapiens
  ENST00000567915
tggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagt

SEQ ID NO: 602 - DNA, 632 bp, Homo sapiens
  ENST00000569132
attccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttct

SEQ ID NO: 603 - DNA, 558 bp, Homo sapiens
  ENST00000564103
gtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcctctagcctcctctgcttccagcaccaggaggagagcctggctcagggccccccgctgttagccacttctgtcacctcctggtggagccctcagaacatcagcctgcccagtgccgccagcttcaccttctccttccaca

SEQ ID NO: 604 - DNA, 699 bp, Homo sapiens
  ENST00000562467
tgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagt

SEQ ID NO: 605 - DNA, 558 bp, Homo sapiens
  ENST00000568700
gtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagacagggtctcgctctgtcacacaggcatgaaccactgcgctcggccccactgtcccttgatggttactttgtgggcaggcaggggtgaggatggaagggcaagggcccgtcctgaggctgcagagaaggtcttggtgaaggaggatgaggtctgaatagggtgagagagcagagactggaaagggactgaagatcaagagccccaggaagaattcttcctcagcatcagtgtagactgtttatttcctttcacagaggaggaaactggggcacagagaggatgcccaaagctgcacagctagccaatgggagagccaggatttgaacccagcagctgattggagtggggtaggggtgaggggcggag

SEQ ID NO: 606 - DNA, 3820 bp, Homo sapiens
  ENST00000540164
ccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactgg

SEQ ID NO: 607 - DNA, 560 bp, Homo sapiens
  ENST00000568531
ttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccaggtggtgacttccaagagtgactccgtcggaggaaaatgactccccagtcgctgctgcagacgacactgttcctgctgagtctgctcttcctggtccaagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcga

SEQ ID NO: 608 - DNA, 525 bp, Homo sapiens
  ENST00000564360
aagtccagggcgtgaggggactggaagtgcaggaaagagccaccagtggggctgggatccaaggtcacctggggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggaga

SEQ ID NO: 609 - DNA, 563 bp, Homo sapiens
  ENST00000568074
accagtggggctgggatccaaggtcacctgggtgagttctgatgggctccctgatttgggcccttgggaggatggcgtccagctgaacccatggaaacacattgttggaagctttctttactgtgacttttcaagagatgtgctttctaagagtcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgacccca

SEQ ID NO: 610 - DNA, 586 bp, Homo sapiens
  ENST00000563414
agacaactgaggtccggctgtggtttgagagggaagacagtctagaggggtcaggggagacggttcagcatcctctttgtcccttgctaccagcttggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttg

SEQ ID NO: 611 - DNA, 554 bp, Homo sapiens
  ENST00000568618
acttggtgagtggaagctgtgatcctccctctcctcttagaatctccctggattccagggcccttttcactgcaccagataagacccctgtttagtcccactcatcatctggtgtcctgccaggcatggggactgggaggatgtgggggcctgaggccaggacactgggactctcacagacgtgtcacaaggttgtcatcacagggaggaggaccagtgtgtgcaaaggcttggaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactgga

SEQ ID NO: 612 - DNA, 586 bp, Homo sapiens
  ENST00000569494
gtcacggggctaagtgctatccaaggcaaagggacaccaaggggcaaaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacgg

SEQ ID NO: 613 - DNA, 855 bp, Homo sapiens
  ENST00000566169
gctatccaaggcaaagggacaccaaggggcaaaggtctgtgggtgggatgcctgtgctcgggggcgggcagtggtcactgtgtgtaaagggaagaaggaagcagtggatggccaggttcgtgggtcttcccggcaggagacagcagagaggcgcctgcccgggaagggttaatcccagagccgtccaggtcctgtccactcaacttccacctccatcctctgaggaaatgggttttccaggagcttggcctgggcagcggtgactcgtggctccacacggaagtgactcaggtcccccgggagaaagcgagccgtgggtccccactgcccaccgtgcagaggggcagggctgagccaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgcc

SEQ ID NO: 614 - DNA, 536 bp, Homo sapiens
  ENST00000568157
gtgtaaagggaagaaggaagcagtggatggccaggttcgtgggtcttcccggcaggagacagcagagaggcgcctgcccgggaagggttaatcccagagccgtccaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagg

SEQ ID NO: 615 - DNA, 578 bp, Homo sapiens
  ENST00000569154
aatcccagagccgtccaggtcctgtccactcaacttccacctccatcctctgaggaaatgggttttccaggagcttggcctgggcagcggtgactcgtggctccacacggaagtgactcaggtcccccgggagaaagcgagccgtgggtccccactgcccaccgtgcagaggggcagggctgagccaggtggtgacttccaagagtgactccgtcggaggaaaatgactccccagtcgctgctgcagacgacactgttcctgctgagtctgctcttcctggtccaagcccctgccacggggtcccatctgcagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctcta

SEQ ID NO: 616 - DNA, 734 bp, Homo sapiens
  ENST00000569101
gcagaggcagggcccttgcctgtggggccgtggttggtactgagcgcctgatggctgaggccctgtagcgctggggatctgcggctccagaggcagagacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggagg

SEQ ID NO: 617 - DNA, 601 bp, Homo sapiens
  ENST00000563862
gtggttggtactgagcgcctgatggctgaggccctgtagcgctggggatctgcggctccagaggcagagacaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttct

SEQ ID NO: 618 - DNA, 533 bp, Homo sapiens
  ENST00000564722
ggttggtactgagcgcctgatggctgaggccctgtagcgctggggatctgcggctccagaggcagagacagccatgcctactgacagtgaaggctcactttgaaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcag

SEQ ID NO: 619 - DNA, 523 bp, Homo sapiens
  ENST00000569158
agcgctggggatctgcggctccagaggcagagacagggccaatccaggagggctgaagtgacacggtggttctgctttgtccttcagccatgcctactgacagtgaaggctcactttgaaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttcc

SEQ ID NO: 620 - DNA, 545 bp, Homo sapiens
  ENST00000566187
acagagatacttagctgagactgatggcacctgcctctaagccgtttacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagt

SEQ ID NO: 621 - DNA, 602 bp, Homo sapiens
  ENST00000565505
cgctacctgggcagaggggcccgagcctggagtcagggaggctggtgggtgtggagtcccaggaaccaccaccaagccccgcacatccctcctaaggaggcctggctgggccctctctgctccgtgtgtgtagccgaaggtgtctgcggagggtgctgagcaaggcacatcccaccccatcccgctggggctggcattgctggcgggttctgtaagacacaacccccacgggttggcctcatctgagtggccttggcagagtccactctgcttcttgaagcctcagtttcccctttgtaaagtaaagatcgaggcattcagagtcatgtcagggtggtagggggcagaatgggagggtcctgggacctgaatcggcagcctcggcgggggcctgtccacccctcccccaggtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgt

SEQ ID NO: 622 - DNA, 561 bp, Homo sapiens
  ENST00000565391
ctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtctttggcacctatgtccctggctacctactcaagctgagcgccatgggctggggcttccccatctttctggtgacgctggtggccctggtggatgtggacaactatggccccatcatcttggctgtgcataggactccaga

SEQ ID NO: 623 - DNA, 3860 bp, Homo sapiens
  ENST00000456916
gagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactgg

SEQ ID NO: 624 - DNA, 12636 bp, Homo sapiens
  ENST00000512091
ttcttaagcggcggcggcagcagcagcagcaagagaaggagaagcagccccagctatgactgccgcatgttaatagctgccgctgggtccctcggctgctgctggagacagagcctgactccgaagttgtgcaactgtggactgggagagacatttgaaccctcttttcttttcgctccccttttgcccccttggggtgtgtgaagcgaggaacgtaaaggaaggcgaacatttggctctctttttccttcccctttctccgtggctgtgtagcggaagaaagggaagagagactttttgttgttgtttccttgactggggtctccaccctcctgctgctttctctgcgcttcgattctcgttatttgccgcgtgtggttgggggtgtctgcacaggggccggccggtcttttgccccgggctcaatggctggattgtggaaactgcacccgccttcaggttgttgagcaactgatgggacgatctcagggaccggcgtttacgaaagaaatgtttaatttggtaaattggaggaaaaaaacatggatttttagcaattgaagagcaaattaaggtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgtattgatgtatgtactatatgattaatcagtctttttatttttctcgcctttctttctttctgttttcaatacataaactttgctaatcctctgtggcccaaatgagccatgcaaaagaaatcaatctgcctagatgaataagctaagcacaaaatcatacaggtttgcagacaaagtaaaccagaaaaatggaatgggcatgtttattttggatgaaatcagatgcataacttaatgttgagcaggttaacatatatgttactatttgcttatctataaaccagctgcagtcactatgcttacctttaaaaccagattcaatcagagatataaatatgaaatttgggggctgggtgagtcatattttttcctcctttgtacattgcattttgatgttagaaattcaaattccctcaatttgctaaaagctgcaaagagaatattcattttataaagatataataagacttttattgtgtttttttcttattctatatatgagggaaatcggaaaagataaagaagttctttcaaagaaactttctagatctctcattactgcagatcctttatagcagtgtccaagtacagatcccctgttagggcaaagctaaaaggaacctgccaaattataatttctcctgtagtgtgttttatctcggggtttcctttttcaaaaatctaaacactatccatctataaatgactatcttaaatcaagtttagagaatggccaataatctgtatatagtttataaatacatgacaaaaaaatttctgctgagccagagtgcatcataaccttcacatcacctcaaaatattttatgtctcattcttttttagtgaattggcatgaatattttttaagtctacagattttatgttagaggagaatcacaagcgttaatgataattaggttttctcacaccacactatggcaatattagcacgtccaaggcttttaacccacccgatacatagaatacatttggcaataaaagaatcctttttagatgtgtttatggtaacttcagaaacacaaatgtggtctgtggattatgagcacttatgcttgttttgtcaaacagtaacctacatgaaagcaactctatcagtaagaagctggtttcacagaaaaatggggaaactacctcaattcagcttgctgattttctgacattgctacctccctgcccattatttttgtgtttctatatggaaatttgaagcaggtagcttctcaagctctacatagaccaaactgaagaaagatcacttgaatacacaaactggtgcagaagaacattcagcatataaagttactaccaagctcttgcatcaagaaaaaagagtgagatttttgaactctatacatcataaatggcatgctttcagagagacttaagatcccaaagattataacagagagaaatttcccctgcaagtattatgtaaccgtaattaaaaaaaatggataaaggagctaattttacatacatttcaatagaaatttgcatatatctaacatattcattttgtcctgtttacactagcaagggttgaattcctgaacttgaatctttttcttcatatacattttcttatagagctattgatgaattaattaatgattttttaattgttcttttttctaccaccttttgtgactcaattttttaagatcctgagacatttatgacctgcttatctgtatatttttatgtgttcatctgaatttccagtaagaagtaaatttccgtcaaacagatgtagtataccgctataatacagcttatttagccagctagaagtaaaacttatgccaccgaaacaaacaaatgattactttcttgtcaaataatatttttgtcacatttttagacttggttgtttttcctctttgaaatctagttcacatgacactttatcagggacactagctaatggacctcatgtttagttaattctgaaactgatggattgttgcacagcctctgctcctaactgataaatatttgcggcaaagtccaaattttgtgaaggagaaattggttggaattaaattttatgggcgtcccttcttgtttccactatattataattaaacacactgaagttgaataataaattactgtgctaaaataattgtaataacaaaaatgaactgacagaacaattatcttgaagtaacaataatcaggaaaatatctaacaaaaagcacgtaagggaaatatccttaacttcctgtaaaaaaaattcacattgactctaaattaagatgtagtttatcatctgtattttaaaatatccatcataactaaaaatgttgacatattaaggaaaggatctttaagatctaggtttaagattcttattagtattaacttaattggtatgacaaaacttttcataatagatataagcatataagggaattagtaacatttataaaggacccacatatttaattttaggcattgtcttcagcttccctggacccccaacacatgttgaaatgttattgactagcttgctttttttaaggaatgacattaaaaatttcgactgactttctacattactgtaaagatcaaaagggagaggaaaaatagtttacaagttttctaaagatcaactccagactaatctatatcatcccctaataatgaaaaaacaattagtttttagaagttgtctatcagtactgtaccgaagtgctactgcttggatttttttgttgtggttttaaagagatggggtcttgctctgtcacaaagactgaagggcagtggcacaatcccagctcactgcagcctcagactcttgggctcaagtgatcctgctgtctcagccttctgcgtagccatgatcacaggtttgagccacagcacttggcctgtgatgtattgcagagggaaaaaaaccaacactacagaagtataatgcatgtcaattcagatttagagagtgtaaaaaacaaaaacccaaagtccaactatttagttttgagcaaatctgaagatattggcatgaatatcctttcttctctaagaaaatttttgagataacaatatatatgaagttcccagtacattgtagaccaaggtgttaaaatttaattagttcatttttagtaattcataattttaacttaccacataaacaattactatgcatttctaagtaacgttttcaatatagcttatattagatttctgcacatcattaaattacgaagatggcacaaaagcaaagcagcaacattgcacaatagcttatggaagcatttttgtgcgaatggattttacataagaagcttttctgagctcataaaatatattcaatggatcccaacattaaatttaactttgcaatcagcaaatatgttctttataacatcttaaaaatattaaacaattaaattttcatttgtaggctagcagaacttaaatgtgttggtagttgcttctttcctgattaggccataagaagaaactttcctatttactaattaacactgattacactctctttggtttaaaagggaaactttcacctgtacacatacacactctgattccatttatttacagcctgcagaagaagtagcttgtttacgatatttaaaactttgtgatttctgcaataaaacaggtagttaatatagtttcgcataatctcattgaaagatattgctattccttctttatttaaaaaaaaatttaaaagtcagcacttctttcacatctagcacctataagttactattcaaatgtcttgatttcagctaagttttgatgtttctttttctcttaatagtatgtcaaaagcattgttctcatttgataatttgtgtcccgttacagtatttcaaaggtaaatgcaaactaatttttaggaaggcttgtgaaagaactttgatttatgtgaagaaatcaagaaagactatacatgaacaaatctctattgggataaacaagtctcttcaaccacaatatgaacaacggaagagcagaaaccaaacaagttagcaaacttatggtaaggtgacaggacctaaactagagttacagagaaaagttttccaggaaagaataatgaagtcatttgtagtgataaaaatcttatacactacaccaaatgttacagatgtattccgaaaagtaaaatgggagtttcctatattctgatttcattctgctaattccacgggaaacattaaatactttaaacactcttgagatatttcgtatctagctataccttgtctcaaggaaacatcaatattttataaatgtttcttaaatataagtattttgtctgaattcatcttcactctctaatctgctggctctattgaacaccaacagagttaatgcttttagtagctttgtaccttttaaagctctattatgaatctttctaatacatatgaaattaatattatattagaattatgtacattatacaaaataattcataaccaagaaatattcatactatagaataatttattattatatatatgaatattacattgagactgaacaaataaccactctgctccaaatattactctcaagttctctgcctttaattattatagtcaattcataaaattctacatacagttgtacatggtgggttatcaaagtactccataatccaaatgcatctaaaagtattccaaatgcgcctttcattctagaatactaaaggaaagcgtttgaaagaagaggaaagtaaagcagacttctaactatttaatttaaacattgccattcagattgaataatttttaaatgatgatgctccactctttgatctacagacaaggttacaaaagatttacaattagtccaaaatcagaggattttaaatcttaaaggagttaagtttgtctcaatgatccaagactacaaaatttcttgctacattggcaaggaaatatgtttaaagccgagaactaaaatagctttttaaaatttaaaaattcctctgtttcttctgaatgtaaaacaggcaaaatgatcctgacttcaaaatgaaatatattgattgctctcaaaagatgtttgacaaagttaagtcagtatcttcaatgctttaacagtaggtagaggtctttggggttggaactcaggatacagtgactaggacagagtgcattcttaggctaattagtgcctagtcctctggagtattttttaatgccctgaatttcaagttgtcaaactggtttacatattgaatgacattttgaatcaataaaaatgagaaaaaaacatttaaatttggttttcatgactcatttgagaataaagatttccttcatcaccctaagtaataaaagctgatatgtcttgaaacaactatagacaatcagaatgtgttcatttataaagtatcactggtttgtatattttaatgctgacctttgcctgtgaactagaaaatcaagatttgtagagtcaggttgatttgccttcatttaattcctgcaaatgcattggaagtggatggataacttggaactttttccatactgttttccccctcaccaagcattaaatctaattcaaaatatgtctttctaaaaaacaatagtttatttttaaaactaacaactaattgtgttattccttgttgataagaaagtcactttttagaaacaagaatatagctattgtggctttggtcgcttaggattctcatatatttacacatggcattattcttttcatatacacctaccagatttcaagctattggatatttcccttgtacaacctttacatcctttttttttccttaaatgctctgtacaatcacatgtaaagtcatgagctacaaacctcaataaaaatatcagtaaacaagaa

SEQ ID NO: 625 - DNA, 527 bp, Homo sapiens
  ENST00000509779
gtcttttgccccgggctcaatggctggattgtggaaactgcacccgccttcaggttgttgagcaactgatgggacgatctcagggaccggcgtttacgaaagaaatgtttaatttggtaaattggaggaaaaaaacatggatttttagcaattgaagagcaaattaagccacagtggaaacagcaatccttcaatggccaccccttgctctttcacaaactagtgtgtgggcctggaatgtataacctcaccttccctgtcacaacaactcctccgtgaatttcacagcttctctgaaggtttcagcgcctccagcagaagtgaactgctcccacctttctttcttcagcagtctgtcaggaactctcaaaatgtgcacaatagtatctgcagtacttcatctttctcactagtttttaatatgtccacagcaaacatatctaagtttgtttggattaatttttgtaaaaaggatgattgcctgagcatgttttgtatattgatttatttcaccaacattaagtacc

SEQ ID NO: 626 - DNA, 6297 bp, Homo sapiens
  ENST00000514591
agaaagcggacaggagggcgacttttctccgtcaggctggaactggtgccgctggaggcgggagcgggctggaggacggacagggtctggaaatgtttaatttggtaaattggaggaaaaaaacatggatttttagcaattgaagagcaaattaaggtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgtattgatgtatgtactat

SEQ ID NO: 627 - DNA, 5069 bp, Homo sapiens
  ENST00000509896
gtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttcccc

SEQ ID NO: 628 - DNA, 5042 bp, Homo sapiens
  ENST00000511324
gtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttcccc

SEQ ID NO: 629 - DNA, 4838 bp, Homo sapiens
  ENST00000506700
gtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttcccc

SEQ ID NO: 630 - DNA, 4982 bp, Homo sapiens
  ENST00000507164
tctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgt

SEQ ID NO: 631 - DNA, 5009 bp, Homo sapiens
  ENST00000508693
tctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgt

SEQ ID NO: 632 - DNA, 4843 bp, Homo sapiens
  ENST00000507625
aaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagactttttttttttta

SEQ ID NO: 633 - DNA, 4789 bp, Homo sapiens
  ENST00000514157
tcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaact

SEQ ID NO: 634 - DNA, 4816 bp, Homo sapiens
  ENST00000504896
tcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaact

SEQ ID NO: 635 - DNA, 4758 bp, Homo sapiens
  ENST00000508946
atgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttctt

SEQ ID NO: 636 - DNA, 4962 bp, Homo sapiens
  ENST00000506720
atgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttctt

SEQ ID NO: 637 - DNA, 4935 bp, Homo sapiens
  ENST00000506746
atgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttctt

SEQ ID NO: 638 - DNA, 4731 bp, Homo sapiens
  ENST00000514996
atgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttctt

SEQ ID NO: 639 - DNA, 640 bp, Homo sapiens
  ENST00000509089
gtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacagtatgtatattcctatacttttcttggcaagagaaaagatactaaactgtgttttgcatgcattgacaaatattctctatgaaaacataaatcacgtaaattaaatgaaaaaattggctaatattaatttttgagaatcatagaccctccctgccatcagaagaattagatattgcctaccctctcctacggcatttacttgtgattatttctgtatatgaatacgtgttctaacacacttttcttaattaatgcaagaatataaaacatttagaaaaaggttgggggagtgttataccaattctccaggtccaagcagataagaggtgaaaatgagcaatacaattttatatgtaatgtatagcagttgatacattttgaatttgatagaattgtatctaagcttcatctgctgtcaacattttgagaattagaaatatattcatccagaaggagt

SEQ ID NO: 640 - DNA, 4284 bp, Homo sapiens
  ENST00000502815
ttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagattt

SEQ ID NO: 641 - DNA, 587 bp, Homo sapiens
  ENST00000508078
acttatgtgctgcctgttaactgtgcctgtgttggctgtttattcaactttatttctggattagatgcatatttcataatgaattgggttcagggatgatcactttcaagctgcaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaag

SEQ ID NO: 642 - DNA, 582 bp, Homo sapiens
  ENST00000508842
accacacctgtggccgaggctcagcgcctcccgtgaggacgcagctggggctcaaccccgccctcctggaccgggctaccctcacctcctgccaccatctttacctgtccccgttagcagggagcactctgcgagaagatggccaaaaggtccgccgccgccgctgtcccggggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacagcttccctcaatcgcagtgagtgagcccaagggcagaaatgagtctatgcctcttactctcatcagggaaaaggga

SEQ ID NO: 643 - DNA, 2221 bp, Homo sapiens
  ENST00000638316
gctgccccgggagccatgggtcctattggagcagagcgaggatgcagagggaggaggcaagggagggggagaaaggggaggaggatggagccctcctcctgatcctgtagtggtagtaagaatcagcagcgcgggcaaggagtacggacgggagtcagaggcagagcgagggtgtgtggagggccggcggggaccgccgggagcgcgcggatgtcggtgttcctggggccagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagatttgagtccagttaaaggaaatatcacctttccccctggcagagcaacagtaatttataacttgacagtactcgatgacgaggttggctaatgttacatacccaaatgggacaaggattctgtgttgcaggacacagtcctgtataaacttagtgtattgtggccagtcgcacctcagctataaatagctgactgttctggaatacatcttattactatttatcttacttaattcacattaaattacacatctaaaagctgatgaatctgaatataactggcaaccatacatcatacaaatatttaagcattttgtataccctggtaatcaatttttgttagtgctttcaattttgagcaagaacaatactaacctagaataaatattttaccataaaagcaaagaaaaattctactgcagttggtattcttttgtttttatttttttgttgttgtttagaaggagtctcgctctgttgcccaggctggagtgcagtggcgcgatctcggctcactgcaagctccgcctccagggttcacgccattctcctgcctcagcctcccgagtagctgggactacaggtgcctgccaccatgcccggctaattttttgtatttttaatagagacggggtttcaccgtgttagccaggatggtctcgatctcctgacctcgtgatccaccagcctcggcctcccaaagtgctgggattacaggcatgagccaccgcacccggcttgtttggatatttttaatgttcacatttatgggaagatttttattatttttatatttcacattggaactagcaaggatagagatacatgatacacctagcttaattgctaagaatgaatctgaacaataatgtgcaaggatgtcccccacatgagctaaacgagagaaaacatgactttttataaaagaaactaagttttgccagaaaagaaaacaaaaagaaaatagctggcaatttgtaaccctccctctaccctcctacaaaaattctgaaactaaatcacaagaaaactcaagagaagggaaaaaatgtattagagtattagaagacattattagaaaagaatttttctcttgaaaaaaaatgaaatatttggaagcattgatatctccagttcctctggttctggaagcaagcaaaaaaacctttttgttttaagatctcagagcattgaacgggctataatttggggagatgattaattatacattttgattgtaaatttgaaagatcaatcgaatcataacattttatttttaagataaatagctttgctttttatattgctgctgatggaggtaaaagcatgcatttttttcacttttatttctaaaatagagtttatggtgaatgaaaagctcacacagcacagtggagattaaccccaagatttctctgcagc

SEQ ID NO: 644 - DNA, 19557 bp, Homo sapiens
  ENST00000405460
ggtagtaagaatcagcagcgcgggcaaggagtacggacgggagtcagaggcagagcgagggtgtgtggagggccggcggggaccgccgggagcgcgcggatgtcggtgttcctggggccagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagatttgagtccagttaaaggaaatatcacctttccccctggcagagcaacagtaatttataacttgacagtactcgatgacgaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggagcttttgttctacattcaggatagtgatgatgtctatggcctaataacattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagacagggttaacgtggaaaaccaagtgctgaaatctggatatactagccgtgacctaattattttggaaaatgatgaccctgggggagtttttgaattttctcctgcttccagaggaccctatgttataaaagaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtgctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgagattccagaagaaatggaagaatttaccgttatcctactgaatggcactggaggagctaaagtgggaaatagaacaactgcaactctgaggattagaagaaatgatgaccccatttattttgcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtgatacagtagtatatcaatatggagtagctacagtaataattgaagctaatgatgacccaaatggcattttttctctggagcccatagacaaagcagtggaagaaggaaagactaatgcattttggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtggatccccaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagtagctgaactctttagggttgatggaagtggtagtggtgatggggacatggaattcttccttccaactattcacaaacgtgccagtctaggagtggcttcccaaattctagtgacaattgcagcctctgaccacgctcatggcgtatttgaatttagccctgagtcactctttgtcagtggaactgaaccagaagatgggtatagcactgttacattaaatgttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaattccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggtaatgtgacctttgcccctggggaaaccattcaaaccttgttgttagaggtcctggctgacgacgttccggagattgaagaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaatagagccacctccatagacatcgaagaagccaataggaccgtgtatttaaatgtatctcgaactaatggcattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtacaaacaatcattattctggaaagttctcaagtaagatattttacttcagacagccaagattatttaatcattgcaagtcaaagagatgattccgaattaactcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggagatcagaattcaattgatattttcatctgggagatgggacagtcttccttcaggtattttcagtctgtagattttgctgctgttaacagaatccactccttcacaccagcctcaggaatagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagaggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgagactgagtcccagaagaccattgtgttgcacacacttcaagacacagtgttggaggaggacaggcgtttcaccattcagctgatatcaattgatgaggtagaaatatctccagtaaaaggtagtgcatcaataattattcggggtgataagcgagcatcaggagaagttgggatagctccgtcatctaggcacatcctcattggggaaccctcagcaaaatataatggtaccgctattatcagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggctttgaacgatgacattcccgaggaaaaaagcttctatgagtttcagctcactgcagtcagtgagggaggagttctgagtgaatccagcagcactgccaacatcacggtggtggccagcgactctccctatggccgatttgccttttcacatgagcaacttcgagtgtcagaagcacagagggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatctatttggtatcatccagcttcattattgataaagaaacattgtgcatgggcaaaaaaagctaactctatatgtagatgatgacaagcaccctgtgccatcttgcatgaatccaggtgatccagattcaagacttcactgcaactagaagactttaattctgaaaactgtaaaatggtctgtctgttgatgatcctgcacataaatgttgattggagtactgaa

SEQ ID NO: 645 - DNA, 2906 bp, Homo sapiens
  ENST00000640109
agtaagaatcagcagcgcgggcaaggagtacggacgggagtcagaggcagagcgagggtgtgtggagggccggcggggaccgccgggagcgcgcggatgtcggtgttcctggggccagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagatttgagtccagttaaaggaaatatcacctttccccctggcagagcaacagtaatttataacttgacagtactcgatgacgaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggagcttttgttctacattcaggatagtgatgatgtctatggcctaataacattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacaggtacttgtatgattaaaataatcgtaattttggttaaccttcaagtgtactaacctgtgtgaaagaattaactgaacattattttgaccttgttattttgccgtcatttatatgttgttactaaaagttgtttaggtagtcggaagagagattatgcctgctcctaaggtatataagtataaataagacaagaatttttaccaaagttaatattttaattaagtgacattaaaagtacaccagacgtgaaatgccagtcatgcaagtcagactgtcatggatgacatagtagagtaacttacaaactattacaggggagggcgagagaaagagaggctaaccatgctttgaattgatttgggaaaatatgacataggaataggatttgtaggataagtatgttttcataatgaatattgcaaggaaaatatttcagaaacaaagcaatatgagatatatattttttctttttttttgagacagggtctcactctgtcacccaggctggagtgcagtggcggcatctcagttcactgcagcctccacgtcccaggttcaagtgattctcctgcctcagcctcccgagtagctgggattatagatgcctgtcaccacacctggctaatttttgtgtttttagtagagacggggttttcccatttttggccaggctggtcttaaactcctgacctcagatgatccatgcgcctgagcctcctaaagtgctgtgattacaggtgtaagccaccacgcctggcccaagaaaaattttataaatacttttaaataatatactcaaaaatcaatttctttgtctaggtagactctctggaccttcaactgtttagtaaagtccccatgacgtatccttccattttatacatttcatttcttctgttaaccaaaatattatttttatggccaaagtataaaatatctgcactcatttatgatactgttgttgttttcca

SEQ ID NO: 646 - DNA, 1466 bp, Homo sapiens
  ENST00000640281
gagtcagaggcagagcgagggtgtgtggagggccggcggggaccgccgggagcgcgcggatgtcggtgttcctggggccagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagatttgagtccagttaaaggaaatatcacctttccccctggcagagcaacagtaatttataacttgacagtactcgatgacgaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaaggtatgatttattttaaatatattgctaccattattttattatattattccagatttaagttttgtggtgttggacacaacaatgaactgttagaatatgtgtcattttttcccacaaagtttcatgacaaactcagaaaagacacacacacacacacacacacacacac

SEQ ID NO: 647 - DNA, 1309 bp, Homo sapiens
  ENST00000638638
gatcaatcaagagcagagaaaaaaattcacataattgctttcctatataattctttttctatgtaatatttgttttcgtttcacagcatgaacaaatgattttgtttagaatcatttcttttttccttttttttttttgaggcagagtcttgcactgtcattcaggctggagtgtagtggtgcgatcttggctcactgcaacctccgcctcccgggttcaagcaattctcctgcctcagcctcccaagtagctgggactacagacacacaccaccacgcccagctaatttttgtatttttattagagatgaggtttcaccatattggccaggctggtcttgaactcctgacctcgtgatccgcccgtgtcggcctcccaaagtgctgggattacagtagtgagccactgcgcctggcctggaatcatttgtttatttctgaagataagttttttcagttgttaaatatttatgatttttgtttttgtacaccctatctataaacataaatgtcacttgatttatgctttttctcttgattgctgtaattaacatcagttttacttgtcctaatactgtgttaaataagaatgatctatattttgcatttgatagctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagatttgagtccagttaaaggaaatatcacctttccccctggcagagcaacagtaatttataacttgacagtactcgatgacgaggttggctaatgttacatacccaaatgggacaaggattctgtgttgcaggacacagtcctgtataaacttagtgtattgtggccagtcgcacctcagctataaatagctgactgttctggaatacatcttattactatttatcttacttaattcacattaaattacacatctaaaagctgatgaatctgaatataactggcaaccatacatcatacaaatatttaagcatt

SEQ ID NO: 648 - DNA, 1454 bp, Homo sapiens
  ENST00000640083
cagtatgtgatgatgacttaccagagcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagatttgagtccagttaaaggaaatatcacctttccccctggcagagcaacagtaatttataacttgacagtactcgatgacgaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggaggtataacccttgttatgctttatgcttgttaatatttctgtgctgtacaagaaccaaagaatttggtcatacacatcaactttatgtttagtttgaagggacaggaaaaacactggctttgcaaatgatagttttcttactcagtattccttctgaaaataaatattttaccctctaaaaaattccacaaactgtgatttaggaatatttccaaatctgtttttggttcatcttttgctc

SEQ ID NO: 649 - DNA, 5047 bp, Homo sapiens
  ENST00000504142
caagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggagcttttgttctacattcaggatagtgatgatgtctatggcctaataacattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagacagggttaacgtggaaaaccaagtgctgaaatctggatatactagccgtgacctaattattttggaaaatgatgaccctgggggagtttttgaattttctcctgcttccagaggaccctatgttataaaagaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtgctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgagattccagaagaaatggaagaatttaccgttatcctactgaatggcactggaggagctaaagtgggaaatagaacaactgcaactctgaggattagaagaaatgatgaccccatttattttgcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtgatacagtagtatatcaatatggagtagctacagtaataattgaagctaatgatgacccaaatggcattttttctctggagcccatagacaaagcagtggaagaaggaaagactaatgcattttggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtggatccccaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtgagggtcatcatcacaactaggacactgaaatttgcagtttctaaaatttttcattaaaatttagatttttaaaaaagtgctaacatgtatttgaaaactctacttatgcattggtttaatttctttaatcaaaactatgtgcctaccaagataatgagaaattctgtcctgagtgttacagaaatgaatcagagaattttgcccttaaagaacctggaataaaccctagcagagagatgtgtgatatatcacaatgacaccctgtaggaagacagaaaaaaatatgaaagaggaatgtttgtccttctgtgggtagtaggagagatggggagtgatattcctgcagaggaatgaacaaaggaatagaaatgtgaaacagcgtgttgcacctggggaactgctgctagttcagtattgctgaaggtagagggtggtgggcgtgaggttgaaaagaaagcaggagagaagaatcacagtgaaaagtgattatagggttcatactatcagcaggtaacttggtgaattctacagagtgctttgaagagatattctttgttgtctttaaactagatcatatgctgattcctcaagaagcacatttgtgtgtgtgtgcacacaaatactggttatatgcattatagtcaccattccctctcagcccctccatcttatgattttattcttttttatatttcgtgaaagatagagtagagcttatatggctatagcttaatagagtattttcctctgaacctcttacattagttatttggttctattttttttcccagagggggaaaaaaagataggcaaaggaaaatgcacgtatctaccaatttcaatcccatggattttggttacaagcactttgtggtattatccactttttggctgtgtgaatacctacaagtatctgttagccttgattcttttggtgatggtagtggtggtggaatgagaatggaaacgattgggggaagtgggagctggtgttttttcctctgacttactgcagaggaacttgttatttttgtactttgtaatttggaaagataatttttaaactatatgtaaagttattgaactgtagtgccctttatattataaaaatataaaagtatgcatattgtaagtgtacagataagtgaaatttttaaaacttaaattcatcagtttcagcactcatgtgatcagcccccagaccaagaaacagcattccagaagccccctttgactcctccagttgctaactcaccaccctgcctactgactattggcatttttaagagcttaagattcacttttcctatttttaaatttatataaatagaactgaacagtatgtacacttgagtgtccagcttcttttgctcagtattgtttgtgaagttcatccatatttttgcctgctgtagatatttcatgctcattaccatatagaattatcttatgtaactgtaacacaatttatttattagtgctactttcaatttctgttttggttgttttctgttctgcctactacatatagtacttctatggatactcttatacatgttttttgatgaacatatgcctgccatatgcatttctgttgagcacattcctggggatggaattgctgaatgacagtgtgtgcaaatattcggttttagtagataatgcctatcctttttccaaaacagttgaacctaattatactctcacctctagtgtatgagagttccacttaattaatgcttagcttcttccatctttacttttggtttgtagtggcatctcacagtatcataaaaggtgtatttaaaaaaaaataatgctgtgttcaatatagaaaaattgtaaagtacacatatacaacaaaaatagaaatcatttacaataaaaatcatttacaatc

SEQ ID NO: 650 - DNA, 6723 bp, Homo sapiens
  ENST00000640403
ctttctttagctttatttttcccttgccattctaagtttctcacagtattagtgagattttagcaaatggtgccctgcctcctttttccccttcccacacttctttctgtgttgacagggtagaaactgaaaggtttgtcgtgtattttggggttaacgtggaaaaccaagtgctgaaatctggatatactagccgtgacctaattattttggaaaatgatgaccctgggggagtttttgaattttctcctgcttccagaggaccctatgttataaaagaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtgctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgagattccagaagaaatggaagaatttaccgttatcctactgaatggcactggaggagctaaagtgggaaatagaacaactgcaactctgaggattagaagaaatgatgaccccatttattttgcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtgatacagtagtatatcaatatggagtagctacagtaataattgaagctaatgatgacccaaatggcattttttctctggagcccatagacaaagcagtggaagaaggaaagactaatgcattttggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagtagctgaactctttagggttgatggaagtggtagtggtgatggggacatggaattcttccttccaactattcacaaacgtgccagtctaggagtggcttcccaaattctagtgacaattgcagcctctgaccacgctcatggcgtatttgaatttagccctgagtcactctttgtcagtggaactgaaccagaagatgggtatagcactgttacattaaatgttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaattccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggtaatgtgacctttgcccctggggaaaccattcaaaccttgttgttagaggtcctggctgacgacgttccggagattgaagaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactag

SEQ ID NO: 651 - DNA, 3116 bp, Homo sapiens
  ENST00000639676
aagggggtcccttgttaagcagtttctacactaccgagtagagccaagagatagcaatgaattctatggaaacacgggagtactagaatttaaacctggagaaagggagatagtgatcaccttgctagcaagattggatgggataccagagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtgctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgagattccagaagaaatggaagaatttaccgttatcctactgaatggcactggaggagctaaagtgggaaatagaacaactgcaactctgaggattagaagaaatgatgaccccatttattttgcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtgatacagtagtatatcaatatggagtagctacagtaataattgaagctaatgatgacccaaatggcattttttctctggagcccatagacaaagcagtggaagaaggaaagactaatgcattttggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtggatccccaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggtaacctgctccttttgcaagaaaaatcctctcttctctgggtgtacttagttttgttaagaacttcttaaggcactttttgcaaatgacggaagtagaatgccttcagacctcctaatttctaaactctttaacttgtatgctactgttttgagagacattgtttatgagagaaaatataaagatcagtttccaaacttcaataatatgttttgaaaagtttttgcaggattatttaaaatggaacaaagtatttctgttcatagctatcaaatttctttaatttaataattatcctatggtgatttgttaacacctaagtaattgaaatactttgtaatttatattttattaagcttcaagaagtgaagctatcactctatattaatttctttttgtcttatgctt

SEQ ID NO: 652 - DNA, 6608 bp, Homo sapiens
  ENST00000639473
ggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagtagctgaactctttagggttgatggaagtggtagtggtgatggggacatggaattcttccttccaactattcacaaacgtgccagtctaggagtggcttcccaaattctagtgacaattgcagcctctgaccacgctcatggcgtatttgaatttagccctgagtcactctttgtcagtggaactgaaccagaagatgggtatagcactgttacattaaatgttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaattccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggtaatgtgacctttgcccctggggaaaccattcaaaccttgttgttagaggtcctggctgacgacgttccggagattgaagaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggtacagtaagaagctttaatgagaatggaagtttatctttaatatttacaaaataaatttctcttagatgagcactcaagtcctagaatgaaaaaacaatacttccagcttaggtgttagacaaagacatgattcatttactatgtgacaagtgctgtagttctatttactctgtataaagcgcaactggaaaaatttactattaatagggtaaaagaatatgcaaataataaagaaaatatatgtatggctattttaaattttcagcacatttaaattgcatatgtcactttatattgtgtataaaccatataaaagaaaacccaagccaacttttgtaaacattaagtcccagccaatcatttccctttcaccacatttttgttgaacaaaatgtaactgcttacttcagactgcttgtttgacaacaagaatagtttattggagaaaaaaatgctggatttgggataaatatgatctatactcacagtttaccttcccaaacctctttttctatatattaacaattttctgttcctgctactaaactttattttttaaaacagtttaagtttaaaatgcagcacaccaacatggcacatgtacacatatgtaacaaacctgcatgttgtgcacatgtaccctagaacttaaagtataataaaaaaaaaagcaatttgcaagattatgttgcaaatgtgatttttttttttttttttttttgaggcagagtctcactctgtcatccaggctggagttcagtggcgcaatctaggtttactgcaaactccacctcccaggttcaagtgattctggagtgcagtgacgcgatctcagctcactgcaagctctgccttccgggttcatgccattctcctgcctcggcctcctgagtggctacaggcgcccaccactacaggcgcccaccatcatgtctggctaattttttgtatttttagtagagacggggtttcaccgtgttagccaggatggtctcgatctcctgacctcgtgatccgcccgcctcagcctcccaaagtgctgggattacaggcatgagccaccacgcccagctattcccagctaattttttgtatttttagtaaaaatggggtttcaccatattggccagtctggtcccaaactcctggtgccaagtgatctgcccgcctcaacctcccaaagtgttgggattaaaggcatgaaccactgtgccgggcctgtgattattttgactcattttttattgtggaaaaatacgtgtaatataagatttaccattttcaccatttttagtgaacgtttcagtggcattaattatattcacagcaatgtacaaccatcaccaccatctatttccaaaatttttcatcattccaaggacaaactctgtgcccattaagtagtaactccctattactcctctccctagtaatctccagtctactttctgtctctatgaatttgcctattctagatatttcgcatatgtgaaattatacagtatttacccttttgtgtctgacttccttcgcttagcaaaatgttttcaaggtgcatctgtgttgttacaggtatcagaacttcattcccttttcacagctagattatattttattgtatgtatataccgtaatttttaaatccagctatctgttgtttccaccttttgactcttgtcaataaagctcctattattgtg

SEQ ID NO: 653 - DNA, 879 bp, Homo sapiens
  ENST00000450321
ggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagagcttttgattgaagtgtcgcttcccattattatttacaactgtaactgatacattagaatttgcttcaaacatgtctgctgtaaaacctttatcaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagctctgctagatctatctacagatataacgctgtaaaatctggtccttttggatgatctataatgagttgattattaataaaagaagtcaacaataccttaa

SEQ ID NO: 654 - DNA, 611 bp, Homo sapiens
  ENST00000639431
gttccacatatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccac

SEQ ID NO: 655 - DNA, 4680 bp, Homo sapiens
  ENST00000640779
atatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagctgaactctttagggttgatggaagtggtagtggtgatggggacatggaattcttccttccaactattcacaaacgtgccagtctaggagtggcttcccaaattctagtgacaattgcagcctctgaccacgctcatggcgtatttgaatttagccctgagtcactctttgtcagtggaactgaaccagaagatgggtatagcactgttacattaaatgttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaattccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaatagagccacctccatagacatcgaagaagccaataggaccgtgtatttaaatgtatctcgaactaatggcattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatatt

SEQ ID NO: 656 - DNA, 3241 bp, Homo sapiens
  ENST00000640012
tccttccaactattcacaaacgtgccagtctaggagtggcttcccaaattctagtgacaattgcagcctctgaccacgctcatggcgtatttgaatttagccctgagtcactctttgtcagtggaactgaaccagaagatgggtatagcactgttacattaaatttccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaagg

SEQ ID NO: 657 - DNA, 5401 bp, Homo sapiens
  ENST00000640374
gagttgtctcaggtaatgtgacctttgcccctggggaaaccattcaaaccttgttgttagaggtcctggctgacgacgttccggagattgaagaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaatagagccacctccatagacatcgaagaagccaataggaccgtgtatttaaatgtatctcgaactaatggcattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtacaaacaatcattattctggaaagttctcaagtaagatattttacttcagacagccaagattatttaatcattgcaagtcaaagagatgattccgaattaactcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggagatcagaattcaattgatattttcatctgggagatgggacagtcttccttcaggtattttcagtctgtagattttgctgctgttaacagaatccactccttcacaccagcctcaggaatagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccgggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaagttaaacatatcaggggaaagccttgtttcaggctagcgtttcatgtaattttgagtagaaagtgtctcacatttttgttttggaagtcttggccaggcatggtggctcatgccagtaatcccagcactttgggaggccgcagcgggcagatcacgaggtcaggagattgacaccatcctggccaatatggttgaattcccgtctctactgaaagtacaaaaattagctgggcgtggtggcacatgcctgtattcccagatacttgggaggctgaggcaggagactcgcttgaacccaggaggcagaggt

SEQ ID NO: 658 - DNA, 5211 bp, Homo sapiens
  ENST00000509621
ccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaatagagccacctccatagacatcgaagaagccaataggaccgtgtatttaaatgtatctcgaactaatggcattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtacaaacaatcattattctggaaagttctcaagtaagatattttacttcagacagccaagattatttaatcattgcaagtcaaagagatgattccgaattaactcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggagatcagaattcaattgatattttcatctgggagatgggacagtcttccttcaggtattttcagtctgtagattttgctgctgttaacagaatccactccttcacaccagcctcaggaatagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagaggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaagttaaacatatcaggggaaagccttgtttcaggctagcgtttcatgtaattttgagtagaaagtgtctcacatttttgttttggaagtcttggccaggcatggtggctcatgccagtaatcccagcactttgggaggccgcagcgggcagatcacgaggtcaggagattgacaccatcctggccaatatggttgaattcccgtctctactgaaagtacaaaaattagctgggcgtggtggcacatgcctgtattcccagatacttgggaggctgaggcaggagactcgcttgaacccaggaggcagaggttgcagtgagctgagatcacgccattgcactccagcctggcgacatagagagactccatctcaaaaaaaaaaaaaaaaaaa

SEQ ID NO: 659 - DNA, 4505 bp, Homo sapiens
  ENST00000640464
ggcccctttggggctattcagtatctctgcagttgaaaatagagccacctccatagacatcgaagaagccaataggaccgtgtatttaaatgtatctcgaactaatggcattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtacaaacaatcattattctggaaagttctcaagtaagatattttacttcagacagccaagattatttaatcattgcaagtcaaagagatgattccgaattaactcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggagatcagaattcaattgatattttcatctgggagatgggacagtcttccttcaggtattttcagtctgtagattttgctgctgttaacagaatccactccttcacaccagcctcaggaatagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagaggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgagactgagtcccagaagaccattgtgttgcacacacttcaagacacagtgttggaggaggacaggcgtttcaccattcagctgatatcaattgatgaggtagaaatatctccagtaaaaggtagtgcatcaataattattcggggtgataagcgagcatcaggagaagttgggatagctccgtcatctaggcacatcctcattggggaaccctcagcaaaatataatggtaccgctattatcagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggctttgaacgatgacattcccgaggaaaaaagcttctatgagtttcagctcactgcagtcagtgagggaggagttctgagtgaatccagcagcactgccaacatcacggtggtggccagcgactctccctatggccgatttgccttttcacatgagcaacttcgagtgtcagaagcacagagggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaaggtaaaggagaaaggcaattaggaaaaagaaagcaaagagcagagagaaagagagaaagttctattgtgtagagattaatactgagctctaaagcagttctttccctactctttctcagatttgtgtgacattagaacaggacatacaagggaaattatgacaatgactgagtttttttttttaattttgttaaatataacttccctctgaaaattgaaagtatgtgtttctattgtgtggactcactctgggtagccaggaagttgaatatgataacggcttctaattggtgaagacacagcctaacagctctctaaatcagaggtcagctggtgtggctgaatttgcttcttttgatttccatacttgtgaaagggctgaagggagggatttctttcattggtgcatctgaagtctgtatcgtcttctctgtgggtgaatgacatagatgcttgccccatagttttaaagtggggaaaaatttgagtgaaagctagttggccattaatgtgcaccatgttttcaaggaagataatgaattaaccttaatgagtctctttcattccctgatttagtgaggcagatttgatgaggtggaaaaacatctttagcatgtttaagtactcacaggttctgcagctcacaggttgagagagacctaccagcatctctgcccagatagcagataggtgggcccttcaactagagtaatgcctgcatttagaagaatcataaagacatttttcttgtgcatgaaaatatttttgcctttgtaatgtgaatatcatgctttaaaaactttttaaactaaaatatgttactcagtgacttaagtgtatatcatcccatctgggaaaaaaatattgtgggctcacatacccttcaaattttagatttcccaaaaatgcttctatgcctggcaatgagagtgaatttgtactcctagtaaatatagtaaaaagtttgagctgatcactgactattttaattaaataaatgcaatt

SEQ ID NO: 660 - DNA, 8141 bp, Homo sapiens
  ENST00000425867
caacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccgggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgagactgagtcccagaagaccattgtgttgcacacacttcaagacacagtgttggaggaggacaggcgtttcaccattcagctgatatcaattgatgaggtagaaatatctccagtaaaaggtagtgcatcaataattattcggggtgataagcgagcatcaggagaagttgggatagctccgtcatctaggcacatcctcattggggaaccctcagcaaaatataatggtaccgctattatcagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggctttgaacgatgacattcccgaggaaaaaagcttctatgagtttcagctcactgcagtcagtgagggaggagttctgagtgaatccagcagcactgccaacatcacggtggtggccagcgactctccctatggccgatttgccttttcacatgagcaacttcgagtgtcagaagcacagagggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctata

SEQ ID NO: 661 - DNA, 1177 bp, Homo sapiens
  ENST00000639884
gctgagataatgatagaagaaaatgacgatcccagaggaatttttatgtttcatgttactagagtgagatgaactttcatttgtttacagtcatacagaggcctctccctgctgatttggccagtgttttatgtttagctttgcctgtatttatttttaaatagataaataaccaaatttgtcttataaactaattcttaggtctctttgggctagaccaaaggattcaacaagtttactttcattaaatataagagttcagaagaccttttatgcatacttatatctgactattaatttctactttaaagggtgaaatatagaaagttaagtagaaacaataactttagaaagatgacttatgagagttaccattttatcttgcctttcaattatattctttacttaaagggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaagttaaacatatcaggggaaagccttgtttcaggctagcgtttcatgtaattttgagtagaaagtgtctcacatttttgttttggaagtcttggccaggcatggtggctcatgccagtaatcccagcactttgggaggccgcagcgggcagatcacgaggtcaggagattgacaccatcctggccaatatggttgaattcccgtctctactgaaagtacaaaaattagctgggcgtggtggcacatgcctgtattcccagatacttgggaggctgaggcaggagactcgcttgaacccaggaggcagaggttgcagtgagctgagatcacgccattgcactccagcctggcgacatagagagactccatctcaaaaaaaaaaaaaaaaaaaaaaaaaaaa

SEQ ID NO: 662 - DNA, 1360 bp, Homo sapiens
  ENST00000640729
ggacttgtatgcaaaataaatagttctggtaaatcaatgtattgaatctcctctctttatctcagattaataaaaaccacttttaaattttgactcgctaaagtaggtacaccataattcagaggacagtttaggtctgtattatgtgaggagcctgattgtagtaacaaagatcccgccaagtctcagtttcttcatatggtaaatgtgcatttcttcttcacgcaggaatcctgcaccagcgtgcccagttggctgatgcttatggacacctcttattcagctggcagctctcaggccctagactctgtccatcttggggttatgtcctcttctaggtcctgggcctcctctctattcacctgccaaatggaaaagtagaggatgtggggtcttgtgtgggtgtttatggcaagagtattagcagcataaatcatttctgcctctattctctgggtcagaattcagtcacatgctctacctaattgcaagagaagacaggaaatgccaactagttgagcatctaggaatagaaagtgggatttggtaaaaaaaatttttctgccacatgataattacatgtaacattctaaattataaaactgcagtcattgtaaacagaaataagattctacttgtttatcctgctctttttgtttttttttttgtttggccttactgaattttcttctttcaggtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgagactgagtcccagaagaccattgtgttgcacacacttcaagacacagtgttggaggaggacaggcgtttcaccattcagctgatatcaattgatgaggtagaaatatctccagtaaaaggtagtgcatcaataattattcggggtgataagcgagcatcaggagaagttgggatagctccgtcatctaggcacatcctcattggggaaccctcagcaaaatataatggtaccgctattatcagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggctttgaacgatgacattcccgaggaaaaaagcttctatgagtttcagctcactgcagtcagtgagggaggagttctgagtgaatccagcagcactgccaacatcacggtggtggcc

SEQ ID NO: 663 - DNA, 6503 bp, Homo sapiens
  ENST00000638510
attactgtatatgtatgtattcagccgtgattcccaaaggttcattttatgacagcatctttctgatttcctcacagtttattatcttcccattgcccaagtttagtaactttatattagttttggcttcgtacaggcaccactcattgggagcaacacagaaatctgtttcaaaacatcatttcaggaaaaagagaatattttagcgttgaggatctttaaaagtattgcagtactttatagaactaagttgtaggagctaagaggatcttttaattcatgctatgcaattatgtattttttgttgttgttgtattttattttattttgatttgtatgactttggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatct

SEQ ID NO: 664 - DNA, 2467 bp, Homo sapiens
  ENST00000638975
acctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtttgtggcatttcttcagtttcctgatcattccaataaaaccctttcaggagtgcccatgcttacctcataatcagtttgaaatcttattcaggtatttaaatggaaccacaaaaaaatgccctcgaaaatgtttagtaactactggataatacatttgcagattataataagtatattactatttggatggagataatagatttttgtgtagaaagtaacagacacttatttaatacttacaaagttctaggaaatgtttccagtggtgtgcatatacacctgcacacccatggacatgtgtatgcacacgcacacacactgatacttgtcaaaggggagaaatttataggcttctttgtgcttctagcaaagagtagtgcaatgaaatagattacatgaagaggatttgtgaatacagagactggtaactgcttctctttttgaaaagttgaaatgtaggaaattggctatgatattctctaatggtaatgaggagaaatcatagcaggctgctctgccaagatctggggtgggtgatcagaatgcatggatgtcctgtggctcaagcagacagcccagcagtctttctcagtctgaaccacagaaagtgattgagtgactttttttttaattcctcccaaggatggtacatgtcatatcatcctctgtgcatgcattatggcattcattgccactggatgcattatggcattgggattaattatctcatgggcaagaaaggctgtccaagaagtagacagattggtgtcatcttgagaaaaacttgcagggtgaattatgtagctagagagaatgaaaaaggagaatatattctctctgtcgaggaatggtgaagaggggaattctgaagcctttgggaacacccaaatcaactccatgaaggcttgagcatttgggtgctgctttcatggaggtgtgttattcagccagtgtcagcttagtttcatataaacttgtgatccatagaaaataggctatcatttccggataagcaacaagcctattacactaatccatacttacagtgctaccttttgatgtgttgtgtactcgagccttttgtagttgcttaataaagaaaacaaatggggtcttcttagtgagacatgggtttcatagctattcctacattcctgtacaatatgtcctcagttaatgtccacaggttcttggaaactgcagctttaagtgaaatgatgtacaatgtaaccaattttaccgtaagctaattgatataaaaaacaatagttaagttcctacagcatatttctggtcacaaaaacagcgccagacttat

SEQ ID NO: 665 - DNA, 5673 bp, Homo sapiens
  ENST00000640407
aattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaagagaaatgctactgagcccattatcaaaagtttcagttaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaa

SEQ ID NO: 666 - DNA, 631 bp, Homo sapiens
  ENST00000638585
ggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcagatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttca

SEQ ID NO: 667 - DNA, 698 bp, Homo sapiens
  ENST00000507314
gggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggttgtaggttgccagagccttccatggtagctcagggctcaaggcagggatcaaccctggacaggactccatcccatcgcagggcacagtcacactcacacccacactcactcagactggaatcattgacacatgctgattcagcctcacgtgcacatctttggaatgtgggggagactggaacacttggagagacccatgcagatatggggagaatgtgcagactccacacggacagttgccctggctggcaattgatttttttctcatcaacattatatgaaacagcattgagtgaaactgtgtgatttgaagacctgttgtagttccttgggaaactgactcaatgtcatgaccttactttatcaatttctaacctgcatttcctgtatccgacagctctcaaggctaaacagtacaaaaatggaaaaagagaagtggattaagttaaccagagtatcattgtatcaagtctcacttacaaattagaaaaagtttaaaaaata

SEQ ID NO: 668 - DNA, 596 bp, Homo sapiens
  ENST00000513828
aaattttagttctacaaatgaggttctggaaagacccatgaacaagtcatattaaatgccatttaacatattttgctttcatttaaccataattatgcttatctttttttggatgttgttcattcaaaagataacgttttgattaaaaaaagaaaaagctatcaactataacctaaataataaagtaaaataaattttaaagtctgagatgttatttcttaagcacttctctttaattcagtatgagacaaggatatatattgtataaaccaagggaaagtttacgtttaacccattcctcagaaaacaggaaggtttagagagaaataaaatactctaagcatgattttccctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccc

SEQ ID NO: 669 - DNA, 584 bp, Homo sapiens
  ENST00000640061
agtaatcagcgagactctgtgggcgtaggaccctccgagccaggtgcgggatataatctcgtggtgtgccgttttttaagccggtccgaaaagcgcaatatttgggtgggagtgacccgattttccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaact

SEQ ID NO: 670 - DNA, 2433 bp, Homo sapiens
  ENST00000638990
agatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaatcaccagcatgttaaaatcacaaggttgtcttagatgtgaaccatctaccttgctgtgcatgttgagtcccatatctatgccttcaagggcccagtgaaaactcaagagcttataagatgcacagaaagagtggccttttctgttttgttttgttgaatgctgtattcactgggcctagaacaatgtctgaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaat

SEQ ID NO: 671 - DNA, 559 bp, Homo sapiens
  ENST00000505845
cttatcagaaggtaatggagtaagtggcttcacaccaatgcttaaacgataaagatgtggtcctgtgtccggaattggtgggttcttggtctcactgacttcaagaatgaagccgtggaccctcgcagtgagtgttacagttcttaaaggcggcgtgtctggagtttgttccttctgaggttcggatgtgttcagagtttcttccttctgataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaa

SEQ ID NO: 672 - DNA, 1522 bp, Homo sapiens
  ENST00000640815
tatacattgtttgcaaagtaaatgaaacaggttaacttcctggatgcttacttttagcagaaatatatcagatagcaaacttgctgacagatgaatcacagctttgcccacctgtaatgaggatacactgctggatcccagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatcta

SEQ ID NO: 673 - DNA, 893 bp, Homo sapiens
  ENST00000639821
gccttgcaggttgatctcagactgctgtgctagcaatcagcgagactccatgggtgtaggaccctccgagccaggtgcgggatataatcttgtggtgcgtcgtgttttaagccggtcggaaaagcgcagtattcgggtgggagtggcccgattttccagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcaggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatattt

SEQ ID NO: 674 - DNA, 564 bp, Homo sapiens
  ENST00000639707
tgtctggcactccctagtgagatgaacccggtacctcagatggaaatgcagaaatcacctggcttctgcgtcactcaggctgggagctgtagaccggagctgttcctattcggccatattggctcctccccccagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtc

SEQ ID NO: 675 - DNA, 500 bp, Homo sapiens
  ENST00000640369
gcaggcagatccgacagaatgtcgtgtatggatggagaaagagaatgaaacagcagtttaagatgactgattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtctt

SEQ ID NO: 676 - DNA, 904 bp, Homo sapiens
  ENST00000640256
agaaccaacaagagatcacctgcagattggagactgaagaagctggtggtgtatttcaaaagcctgagaggcagaggtgaatggtgtagatttcagttttagttcgaaagcctgaaaaccgggaatgctaagggcagaagaaggaatgttccagctcaagcagtcaagcagaagaaagaaattccactgattttatatctctttgctctgatttccgtgacatggctttggggaggactacacatggcctacagacacttctggatgttggttctctttgtcattttcaacagtctgcaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaa

SEQ ID NO: 677 - DNA, 1101 bp, Homo sapiens
  ENST00000639530
agaaccaacaagagatcacctgcagattggagactgaagaagctggtggtgtatttcaaaagcctgagaggcagaggtgaatggtgtagatttcagttttagttcgaaagcctgaaaaccgggaatgctaagggcagaagaaggaatgttccagctcaagcagtcaagcagaagaaagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaa

SEQ ID NO: 678 - DNA, 1167 bp, Homo sapiens
  ENST00000639212
aaccaacaagagatcacctgcagattggagactgaagaagctggtggtgtatttcaaaagcctgagaggcagaggtgaatggtgtagatttcagttttagttcgaaagcctgaaaaccgggaatgctaagggcagaagaaggaatgttccagctcaagcagtcaagcagaagaaagaacttcaaacctacaaaggaagaaatagaatgagacaagatgagaagcagcaagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatctatttggtatca

SEQ ID NO: 679 - DNA, 1885 bp, Homo sapiens
  ENST00000278175
atccgcgctgtcccttccgcgggctcttgctgttcttcgccaggaggctttgcactccgggccgcatgggtcctggataaggacctcaagaggttgtagtggcgccccttcgctccggcgtactgtctgaaccctgtgcccaaagagggctgtggcagttcctgcaccaaccgcctggagcccatacctaagccctctgggcacgagggacctcctctcccccgctcccccctccccccatcccaactccagccccaaaggaagcaatgcgcgcgtccgagagcaggagcgcgcgtggctgaggaaagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctga

SEQ ID NO: 680 - DNA, 1640 bp, Homo sapiens
  ENST00000534464
actcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgct

SEQ ID NO: 681 - DNA, 1839 bp, Homo sapiens
  ENST00000530439
ctcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttcccggtgttggggccaaagctctgcttgatggggtctcaagttgcctttcttccccctccccccgcccgcagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatat

SEQ ID NO: 682 - DNA, 584 bp, Homo sapiens
  ENST00000524948
agtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttc

SEQ ID NO: 683 - DNA, 1889 bp, Homo sapiens
  ENST00000528655
tcttggtgacactggatagaacagctcaagccttgccacttcgggcttctcactgcagctgggcttggacttcggagttttgccattgccagtgggacgtctgagactttctccttcaagtacttggcagatcactctcttagcaggtaggtgccgcagaccctgcgggttaagaggtggggtggggggcagtgcttgccaaggccctaaactgggagcgctgggtgaggggaacaacccactttggagggttctctgagagatagatacaccccatatcctgggcccagctcgtgcacacagctggaggtccagagacccagtcccctctgctccgtcagccaagttccaagaagttgagcagagaccctctgggagcctggcggggtgcagcggcctcccctgcggggcctgtcacccggccggcgcgtgcaaacgcctctggcgcctctctgcgcggagggagataagcgtctgagccagggaaagcgcgggctaaacccgcctcgccggggcccctgcccgccctccgtgccccgcccgggcggtgcagctggcccgggtgctcacgctcgactctctttcttcttttccagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgg

SEQ ID NO: 684 - DNA, 641 bp, Homo sapiens
  ENST00000526492
ggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagttgcctttcttccccctccccccgcccgcagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccgg

SEQ ID NO: 685 - DNA, 867 bp, Homo sapiens
  ENST00000525063
ggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcaccgtccggcggcgagctctggctttgcaagggcccctccttctgggggcttcgcttccttagccttgctcaggtgcaagtgccccagggggcggggtgcagaagaatccgagtgtttgccaggcttaaggagagga

SEQ ID NO: 686 - DNA, 586 bp, Homo sapiens
  ENST00000528544
gtgcacacagctggaggtccagagacccagtcccctctgctccgtcagccaagttccaagaagttgagcagagaccctctgggagcctggcggggtgcagcggcctcccctgcggggcctgtcacccggccggcgcgtgcaaacgcctctggcgcctctctgcgcggagggagataagcgtctgagccagggaaagcgcgggctaaacccgcctcgccggggcccctgcccgccctccgtgccccgcccgggcggtgcagctggcccgggtgctcacgctcgactctctttcttcttttccagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctg

SEQ ID NO: 687 - DNA, 2896 bp, Homo sapiens
  ENST00000309502
atgagtgtcagaagtgtgaagggtgcctgttctgaatcccagagcctcctctccctctgtgaggctggcaggtgaggaagggtttaacctcactggaaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctaccgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagccttggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccct

SEQ ID NO: 688 - DNA, 3407 bp, Homo sapiens
  ENST00000367236
aacatgaggggattggactggatgccttatggcttagcgctgtgctatgaagaggaagaaggaggaaggaaaaggagcgcagagcgggttacactgccaggagatcctgggaagctaggtcacttccctgagcctcagcatccttatctgcaaaatagaaattgctaatagactaaaaggcaattctgaaagatggatgagaaaggaatataatgactcagggtagagcctgcaaaacaatatgggatgagaagatgcagggactggtttcatggagagagcagggttttaggattgggggagggtgccagggctaccgactgctttgggagatcccagagggggcattctgaagtcctgcagaagagatgctgtgccgtgaggggtgaggggtcgctggaggccagaccagggctcccaggagtcctgcattgagaagggagagagtggacacaggaaggatgcgcctctgtccagtcctgaggctgggcgcacacaccaggcccttcgaaaagctcacattttttccagcttttctcacccagtatcacttcctttgttaagaggagggggtgggggaggagacggaggatgaggagggaggggctggcgggtgccgccgccgcccccgccccctcccggtgtgcggagcccgattgtcactcagctcctgcgccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagccttggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccctg

SEQ ID NO: 689 - DNA, 2219 bp, Homo sapiens
  ENST00000367235
cggaggactatgagctgccgcgcgttgtccagagcccagcccagccctaccgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggagaataagccaatgcatggcaagcactaaatcttagatcctgaagactcagccctcgagcaaaagacatgcacctccccactcaccgggccctggaagaggagggtgctcctcttagaggcccctggaggccaggcgtgcctcagaggggcctttcgaggcagctgggaggcagatcctcacactctgccctcctctcccccaggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagccttggagtgtaattacctgtcatctgggccaccagctc

SEQ ID NO: 690 - DNA, 751 bp, Homo sapiens
  ENST00000464019
gctgcttctccagccagaccacggcaggcttcccaaaggcacgctttggctctctcattcaccaggagaataagccaatgcatggcaagcactaaatcttagatcctgaagactcagccctcgagcaaaagacatgcacctccccactcaccgggccctggaagaggagggtgctcctcttagaggcccctggaggccaggcgtgcctcagaggggcctttcgaggcagctgggaggcagatcctcacactctgccctcctctcccccaggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatc

SEQ ID NO: 691 - DNA, 1636 bp, Homo sapiens
  ENST00000472535
gtcccaaaagtggtgtcttcttgagttctgatgcagcaggaagaactgaagttagactctgggaaggactttctaatgtggaagcacaagctgtggaatgcggagctgagtgtgggggtggactctttctttggaaagatttccaaggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagccttggagtgtaattacctgtcatctgggccaccagctc

SEQ ID NO: 692 - DNA, 968 bp, Homo sapiens
  ENST00000467253
gctccttttgccatcccggtcttccttggagagatggagagaatcaaatctcagtgcagaaagagctgagaatgccaaggtctgggtccagttttcctgcatttactgtccaggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaa

SEQ ID NO: 693 - DNA, 2919 bp, Homo sapiens
  ENST00000337894
gtgcggagcccgattgtcactcagctcctgcgccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctaccgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagccttggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccctg

SEQ ID NO: 694 - DNA, 653 bp, Homo sapiens
  ENST00000640524
gtgcggagcccgattgtcactcagctcctgcgccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggagaataagccaatgcatggcaagcactaaatct

SEQ ID NO: 695 - DNA, 862 bp, Homo sapiens
  ENST00000618295
tctgttccctggaactttgggcactgcctctgggacccctgccggccagcaggcaggatggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccac

SEQ ID NO: 696 - DNA, 1735 bp, Homo sapiens
  ENST00000304222
gggcaatttgttagttatccgccgccaccaagacgcggcacggcgcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatgta

SEQ ID NO: 697 - DNA, 1875 bp, Homo sapiens
  ENST00000582124
tgtataacaaagccaattttaccacagttgatactgttaaaagaaaaacttcggctgaattcaatttaaaagagcttaattgagcaaagaatgattcacaaattgtgcagcctgctgagccaaagcaggctcagagactccagtgcagtcacgtggtggaagataatttatggacagaaaaaagaaagtgatggacagaaaaaggaaaagtgacgtacagaaaatggaagtgaggaacagaaacagctggattggttatagctcagcatttgccctttttgaacagggttcgaacagttggccacatttgattggccaaaagtcgaggattggcatgagtgcaggctatagtctgtttacacgtccacttgttgtagtccacgatgtacagagaaacctttaggccaaatttaaaatatgtaaggaggcagctttaggctaaacttgatttaacaatataaacaagagttaacttcctatgacatatacttcaagtcacagtttgagaacccaccgaggacattgaggacttacagtactcccttaaggcttccccacctcttgtcattggccatcctgtgtcactaaacagaaaggagttgctaagtcaagaatgaagatcttactgagttttctagagcaaagctgctcatccctgcttgcatgtctttagtattgagggtaaaggccttagtgccctggaaggtgaactttagaggttgttaaagggtcatggaaaaaagaggaggtggggtcttggattgtggttgcagagcgctataaactgaccgtaacagatggtattcttttaaacaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtact

SEQ ID NO: 698 - DNA, 2304 bp, Homo sapiens
  ENST00000380586
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggacgaagtctcgctctgtcaccaggctggagtgcagtggcatgatcttggctcactgcaacctccgcctcccgggttcaagagattctcctgcctcagcctcccaagcagctgggactacagggatgtgccaccaggccgacgccaccaggcccagctaatttttgtatttttagtagagacggggtttcaccatgttggccaggatgatctcgatctcttgacctcatgatctgcctgcctcagcctcccaaagtgctgggattacaggcgtgagccaccgtgcccggcccaactattttttttttttatcttttttaacagtgcaatcctttctgtggatgaaatcttgctcagaagctcaatatgcaaaagaaagaaaaacagcagggctggacggatgttgggagtggggtaagaccccaaccactcagaaccacccccccaacacacacacacattctctccatggtgactggtgaggggcctctagagggtacatagtacaccatggagcacggtttaagcaccactggactacacattcttctgtggcagttatcttaccttcccatagacacccagcccatagccattggtt

SEQ ID NO: 699 - DNA, 2092 bp, Homo sapiens
  ENST00000519096
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggacatacattcttaaatatgacgtgctgttttggagaaaagggctgtcggtctgcactaggctgcgggagaggaaagagattaaaaactgaaaccagggcagggatgagtgtgctatccacagctgagaagtgaaacacccatgtttaatagggactgacccaggaaaatcagacgaagtctcgctctgtcaccaggctggagtgcagtggcatgatcttggctcactgcaacctccgcctcccgggttcaagagattctcctgcctcagcctcccaagcagctgggactacagggatgtgccaccaggccgacgccaccaggcccagctaatttttgtatttttagtagagacggggtttcaccatgttggccaggatgatctcgatctcttgacctcatgatctgcctgcctcagcctcccaaagtgctgggattacaggcgtgagccaccgtgcccggcccaactattttttttttttatcttttttaacagtgcaatcctttctgtggatgaaatcttgctcagaagctcaatatgcaaaagaaagaaaaacagcagggctggacggatgttgggagtggggtaagaccccaaccactcagaaccacccccccaacacacacacacattctctccatggtgactggtgaggggcctctagagggtacatagtacaccatggagcacggtttaagcaccactggactacacattcttctgtggcagttatcttaccttcccatagacacccagcccatagccattggtt

SEQ ID NO: 700 - DNA, 2089 bp, Homo sapiens
  ENST00000380582
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggggacacacacccatgacatgaagccagcttcccgtccacgactgttgtccttactgcccaaggaaggggagcatgaaacccaccactggtcctgcgacccactgtctttggaatccaccccaggagcccaggagccttgcctgacacttggatttacttctttatcaagcatccatctgactaaggcacaaatccaacatgttactgttactgatacaggaaaaacagtaacttaaggaatgatcatgaatgcaaagggaaagaggaaaagagccttcagggacaaatagctcgattttttgtaaatcagtttcatacaacctccctcccccatttcattcttaaaagttaattgagaatcatcagccacgtgtagggtgtgag

SEQ ID NO: 701 - DNA, 1877 bp, Homo sapiens
  ENST00000521711
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggacatacattcttaaatatgacgtgctgttttggagaaaagggctgtcggtctgcactaggctgcgggagaggaaagagattaaaaactgaaaccagggcagggatgagtgtgctatccacagctgagaagtgaaacacccatgtttaatagggactgacccaggaaaatcagggacacacacccatgacatgaagccagcttcccgtccacgactgttgtccttactgcccaaggaaggggagcatgaaacccaccactggtcctgcgacccactgtctttggaatccaccccaggagcccaggagccttgcctgacacttggatttacttctttatcaagcatccatctgactaaggcacaaatccaacatgttactgttactgatacaggaaaaacagtaacttaaggaatgatcatgaatgcaaagggaaagaggaaaagagccttcagggacaaatagctcgattttttgtaaatcagtttcatacaacctccctcccccatttcattcttaaaagttaattgagaatcatcagccacgtgtagggtgtgag

SEQ ID NO: 702 - DNA, 1838 bp, Homo sapiens
  ENST00000519229
tgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggtcttctggattttgagaagcagctgcaaggatgaacggattggtgttggcccaaattaaaaagaagagtattcagttctttcagtgtttggagaaagaagaccaaaagcatcatctcacagggagcagaatgtgaccagcctggctaatgaggaaatgagagggatcctcaacttgagaacccgctctactgaagtctgaacttggaaaaatggacacattgggtttggagtaagaattcttactctacaaaaggataaaattgtgatcacattgatgcatgatgcctaggatattaaaaatgcatgattaattaaatgttagtctaccttgtgttttaaagggacacacacccatgacatgaagccagcttcccgtccacgactgttgtccttactgcccaaggaaggggagcatgaaacccaccactggtcctgcgacccactgtctttggaatccaccccaggagcccaggagccttgcctgacacttggatttacttctttatcaagcatccatctgactaaggcacaaatccaacatgttactgttactgatacagg

SEQ ID NO: 703 - DNA, 1765 bp, Homo sapiens
  ENST00000354550
tcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggaggggaatggattgtagatatttcaccaagaattgcagagagcatatcaagcatgtgaattttatgatgccaccgtggagaaagggttcagaatgctgatctccaggtagctggagacctaggcagtctgcaaatgaggagtcagctggaagctatggctatgtattatgtgacatcgcttgttcctaagtgaaaactggatatcccaaccttctggcccagtaggtttcatggttaagacctggtagtgagaacattttaggaactatttgcttgggcaggcaatttttcactct

SEQ ID NO: 704 - DNA, 2281 bp, Homo sapiens
  ENST00000276393
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccgggtgagaagtaaaagctttttgcaggtctgctgctgtgtagggccctcaacccccagccttgacaagaaccatcaagttccaaccattaaggtccacaccatctccctcagtgagaacggggaggaagtctaggacaggaaagatgcagaggaaaggggaataatcttaggtacccaccccacttccttctcggaaggccagctcttcttggaggacaagacaggaccaatcaaagaggggacctgctgggaatggggtgggtggtagacccaactcatcaggcagcgggtagggcacagggaagagggagggtgtctcacaaccaaccagttcagaatgatacggaacagcatttccctgcagctaatgctttcttggtcactctgtgcccacttcaacgaaaaccaccatgggaaacagaatttcatgcacaatccaaaagactataaatataggattatgatttcatcatgaatattttgagcacacactctaagtttggagctatttcttgatggaagtgaggggattttattttcaggctcaacctactgacagccacatttgacatttatg

SEQ ID NO: 705 - DNA, 2548 bp, Homo sapiens
  ENST00000380573
acgtcagcgagagctgcaaagttccttgctattcttttctggtgtcggggagctgaatattaaaagggtgattgtggagttaccggttatctgcatttttttttcttttcttattttgactctttttaaaaaatgcaggtaaagtgacagcggttcaggagcttaaagacatcagtggtggaggggtgagtcagcgggtgcaaaaggacaaggatttggtgcctcggagacacggtcccctctccgcctccagagaagagcaggcaggcagctcccgggaccgaagccgggtccacatcccccgcgcgcgagctggtggctcagcagcggcgcttcaggtggacgcggtcaaacgatgccccgcagcctcctgggtctcagcacatattccacacctacgtcccctgacctgtgctcctagaagctggagagagcaggagccttcggtggggcagctcaaaatgtaggtaactgcgggccaggagcagcgcccaacctgtagcgctgcgctacccaaccatcggtccctgcctttgagcgtcgacggctgatcttttggtttgagggagagactggcgctggagttttgaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccgggtgagaagtaaaagctttttgcaggtctgctgctgtgtagggccctcaacccccagccttgacaagaaccatcaagttccaaccattaaggtccacaccatctccctcagtgagaacggggaggaagtctaggacaggaaagatgcagaggaaaggggaataatcttaggtacccaccccacttccttctcggaaggccagctcttcttggaggacaagacaggaccaatcaaagaggggacctgctgggaatgg

SEQ ID NO: 706 - DNA, 553 bp, Homo sapiens
  ENST00000518621
cacagagagcctggtgggttccttccacaccacactctctaccccaccacactggctgccacattaacagggatgctcagagagaccttccacaatggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccgggtgagaagtaaaagctttttgcaggtctgctgctgtgtagggccctcaacccccagccttgacaagaacca

SEQ ID NO: 707 - DNA, 1697 bp, Homo sapiens
  ENST00000380572
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgatgaggaaactgaggcccaagaaggaaaaaatgactcacccagctttaaacaaccagttcaccatgcagcagtgctggggttggaggtgatggagaaggaaaatttggaaggtgtttcaaggaaagacacctgtggggtttggtgaccagttggaatgtaagaggcaaaaaaaagggagaaggaactagatacatattcttctggcaggaactgttaattgggttcctgctcccatcttgcactacagtgagagagataacctggtctcctaccattggaaagcatatcatctgtgctctggaggatgagacaatcaaagaaaacaagtaaataagaaaacttaaaaactgtgatatgtaccgtgaaataaataagcc

SEQ ID NO: 708 - DNA, 806 bp, Homo sapiens
  ENST00000518810
gtccctgcagccctgtgaacaactttgacaacctcctgcaccaaattctcaacaatgtttccatcccagtctcagggcacagagagcctggtgggttccttccacaccacactctctaccccaccacactggctgccacattaacagacatggtcttgctgtgtcacccaggctggagtgaagtggcacaatcatggctcactgcagcctagaaccctgggttcaagtgatcctctcttctcagcctcctgagtagttggaactacagacatgcaccaccgtgcccagccaatcttcaggcattcctaccactcttgttgagagagagggctcagaacaaatgccaactgcctctttccactaccttcttccccacctttctcacagtccctcagggaagacagggaagtctttcctcttccttgttctggctaaaggggacactcctcctcctttccagagtggcatccaccttctatggaatagcaaagccaagtggacagcagagagagagagaggcagagagagagagagaggcagagagagagagaggtttactaagaaaagaataaagatgaggaatattttaaaatattataatccttatacatatttaaaactatcttttccacttggttatttgcattttgttgttttatggtttttgcaaatgtttagacatttaaaatatttatatagtcaaatattttcatgttttttcattgaatgtgccttctcagggatgctcagagagaccttccacaatgtaagtctgtttcctcctcattcttttagagcatcatttg

SEQ ID NO: 709 - DNA, 487 bp, Homo sapiens
  ENST00000641205
ctggacattcctggacattgctgggagccagacactgagttgatcatagtgtgctgtcaacagtgaaagaaaatctgagggatcctcacagaaacggggcgcactttggaatgaaggagcacttttggtgctggacaagttgcatatcccgttaaatccggggcccactccgggagccccctattaaaggcgagcgagcgactcggtgcaggcaggagacgtgctgccgggctgggctgcccgggggagatgactcctcgccaggagggcgcctctgggaagaagaccacgggggaagcaaagtttcagggcagctgaggagccttcgccgcagcccttccgagcccaatcatccccctggctatggagggcggactctaagatgaatcccgacctggacaccggccacaacacatcagcacctgcccactggggagagttgaaaaatgccaacttcactggccccaaccagacctcgagcaactcc

SEQ ID NO: 710 - DNA, 537 bp, Homo sapiens
  ENST00000641475
gatcatagtgtgctgtcaacagtgaaagaaaatctgagggatcctcacagaaacggggcgcactttggaatgaaggagcacttttggagaaaagcatgcagcccagagaagtcaagacttgcccaaggttgcacagctagctactaataaaatctggactagaattccaggcttagagatcagcacacttgcctaaaaagagctattggaaacatttttttttgcaaacatacacttcaaatattcatgaccgtcactgtaaacatcaacaaacactactgtcatatacctactatgagtatggggtgctgtatttggcaccttagagcttgggaggacagagtgtgggggttgataacagagaagacgtcatggaagaactaatgcctgaacaaatttttgaatagtgcatacgagttccccagatgaaaaggggaagtaatggagcctatttggaataggctccttcaaacatgaaacctatttggaattgacaactatgttataaatgtaaagtattttattcttaccaaatta

SEQ ID NO: 711 - DNA, 2047 bp, Homo sapiens
  ENST00000306675
cgccgtgcagtcagcccagaagcggctcattgaaagcagaccctcttcggcgctcgctgggcggaggacgcgccgcggtccgcagacccgagcgagctgggcaccgccgggcgcccccggccctgccgccccctcctccccgccgctcccccgcgagcccggccaggcgcgcctgacgtggaccattaaacttggagctgccgcctcgtcccctctcctcctcctcctccctctgacaggcgagcgagcgactcggtgcaggcaggagacgtgctgccgggctgggctgcccgggggagatgactcctcgccaggagggcgcctctgggaagaagaccacgggggaagcaaagtttcagggcagctgaggagccttcgccgcagcccttccgagcccaatcatccccctggctatggagggcggactctaagatgaatcccgacctggacaccggccacaacacatcagcacctgcccactggggagagttgaaaaatgccaacttcactggccccaaccagacctcgagcaactccacactgccccagctggacatcaccagggccatctctgtgggcctggtgctgggcgccttcatcctctttgccatcgtgggcaacatcctagtcatcttgtctgtggcctgcaaccggcacctgcggacgcccaccaactacttcattgtcaacctggccatggccgacctgctgttgagcttcaccgtcctgcccttctcagcggccctagaggtgctcggctactgggtgctggggcggatcttctgtgacatctgggcagccgtggatgtcctgtgctgcacagcgtccattctgagcctgtgcgccatctccatcgatcgctacatcggggtgcgctactctctgcagtatcccacgctggtcacccggaggaaggccatcttggcgctgctcagtgtctgggtcttgtccaccgtcatctccatcgggcctctccttgggtggaaggagccggcacccaacgatgacaaggagtgcggggtcaccgaagaacccttctatgccctcttctcctctctgggctccttctacatccctctggcggtcattctagtcatgtactgccgtgtctatatagtggccaagagaaccaccaagaacctagaggcaggagtcatgaaggagatgtccaactccaaggagctgaccctgaggatccattccaagaactttcacgaggacacccttagcagtaccaaggccaagggccacaaccccaggagttccatagctgtcaaactttttaagttctccagggaaaagaaagcagctaagacgttgggcattgtggtcggtatgttcatcttgtgctggctacccttcttcatcgctctaccgcttggctccttgttctccaccctgaagccccccgacgccgtgttcaaggtggtgttctggctgggctacttcaacagctgcctcaaccccatcatctacccatgctccagcaaggagttcaagcgcgctttcgtgcgcatcctcgggtgccagtgccgcggccgcggccgccgccgacgccgccgccgccgtcgcctgggcggctgcgcctacacctaccggccgtggacgcgcggcggctcgctggagcgctcgcagtcgcgcaaggactcgctggacgacagcggcagctgcctgagcggcagccagcggaccctgccctcggcctcgccgagcccgggctacctgggccgcggcgcgccaccgccagtcgagctgtgcgccttccccgagtggaaggcgcccggcgccctcctgagcctgcccgcgcctgagccccccggccgccgcggccgccacgactcgggcccgctcttcaccttcaagctcctgaccgagcccgagagccccgggaccgacggcggcgccagcaacggaggctgcgaggccgcggccgacgtggccaacgggcagccgggcttcaaaagcaacatgcccctggcgcccgggcagttttagggcccccgtgcgcagctttctttccctggggaggaaaacatcgtggggggga

SEQ ID NO: 712 - DNA, 2728 bp, Homo sapiens
  ENST00000379453
ccgacgggacccgtgcgcggagctgcatctggagccccgcggctatgccctgtgctcccctccctgccggccgctcgttctgtgccccggcccggccaccgacggccgcgcgttgagatgactttccgcgatctcctgagcgtcagtttcgagggaccccgcccggacagcagcgcagggggctccagcgcgggcggcggcgggggcagcgcgggcggcgcggccccctcggagggcccggcggtgggcggcgtgccggggggcgcgggcggcggcggcggcgtggtgggcgcaggcagcggcgaggacaaccggagctccgcgggggagccggggagcgcgggcgcgggcggcgacgtgaatggcacggcggccgtcgggggactggtggtgagcgcgcagggcgtgggcgtgggcgtcttcctggcagccttcatccttatggccgtggcaggtaacctgcttgtcatcctctcagtggcctgcaaccgccacctgcagaccgtcaccaactatttcatcgtgaacctggccgtggccgacctgctgctgagcgccaccgtactgcccttctcggccaccatggaggttctgggcttctgggcctttggccgcgccttctgcgacgtatgggccgccgtggacgtgctgtgctgcacggcctccatcctcagcctctgcaccatctccgtggaccggtacgtgggcgtgcgccactcactcaagtacccagccatcatgaccgagcgcaaggcggccgccatcctggccctgctctgggtcgtagccctggtggtgtccgtagggcccctgctgggctggaaggagcccgtgccccctgacgagcgcttctgcggtatcaccgaggaggcgggctacgctgtcttctcctccgtgtgctccttctacctgcccatggcggtcatcgtggtcatgtactgccgcgtgtacgtggtcgcgcgcagcaccacgcgcagcctcgaggcgggcgtcaagcgcgagcgaggcaaggcctccgaggtggtgctgcgcatccactgtcgcggcgcggccacgggcgccgacggggcgcacggcatgcgcagcgccaagggccacaccttccgcagctcgctctccgtgcgcctgctcaagttctcccgtgagaagaaagcggccaagactctggccatcgtcgtgggtgtcttcgtgctctgctggttccctttcttctttgtcctgccgctcggctccttgttcccgcagctgaagccatcggagggcgtcttcaaggtcatcttctggctcggctacttcaacagctgcgtgaacccgctcatctacccctgttccagccgcgagttcaagcgcgccttcctccgtctcctgcgctgccagtgccgtcgtcgccggcgccgccgccctctctggcgtgtctacggccaccactggcgggcctccaccagcggcctgcgccaggactgcgccccgagttcgggcgacgcgccccccggagcgccgctggccctcaccgcgctccccgaccccgaccccgaacccccaggcacgcccgagatgcaggctccggtcgccagccgtcgaaagccacccagcgccttccgcgagtggaggctgctggggccgttccggagacccacgacccagctgcgcgccaaagtctccagcctgtcgcacaagatccgcgccgggggcgcgcagcgcgcagaggcagcgtgcgcccagcgctcagaggtggaggctgtgtccctaggcgtcccacacgaggtggccgagggcgccacctgccaggcctacgaattggccgactacagcaacctacgggagaccgatatttaaggaccccagagctaggccgcggagtgtgctgggcttgggggtaagggggaccagagaggcgggctggtgttctaagagcccccgtgcaaatcggagacccggaaactgatcagggcagctgctctgtgacatccctgaggaactgggcagagcttgaggctggagcccttgaaaggtgaaaagtagtggggccccctgctggactcaggtgcccagaactcttttcttagaagggagaggctgcgggctccgtggggccttttgctcccaatccctatttgagaaacactgccccatcctccatgccctgaaccctgagtagacagccccaagcatggccaggaaggcctgcccctcctcttctgggaaataggcacagaagctttggccggctaccccagtgcctcccttagggaaaaagtcagtgggaccagggctcctcagtggacaaatttctccttcttactgccaactggaggaacccagtggacctaccaccacccacaagctttggtggcagattgtatagccgtcatacaagcctgctgtatttatccatgggcccgctgtccgccacccaggctcctccgtgcacaccccatcacctggcccctaccccttattacttcccctcaagggccttactgtttacactctgtacatagctcatcgtgcctgtgcccatcacttcttgctgggattccaagccaccaattggagagctttatttgtcattttgagacatatttattggtaagagtacttctattttgtccaagctgtgcaaactgtccctctttagcccataacccattaaaaaaaaaatactttttcccctaaagtctgtcaagaactaaaggcccgcaacagaatagattgggtctacatttgc

SEQ ID NO: 713 - DNA, 512 bp, Homo sapiens
  ENST00000621688
tctaactctactctggtttgttgcctacattcattgaaggtaatcctcaatatcaggtagaggctccttgttcccgcagctgaagccatcggagggcgtcttcaaggtcatcttctggctcggctacttcaacagctgcgtgaacccgctcatctacccctgttccagccgcgagttcaagcgcgccttcctccgtctcctgcgctgccagtgccgtcgtcgccggcgccgccgccctctctggcgtgtctacggccaccactggcgggcctccaccagcggcctgcgccaggactgcgccccgagttcgggcgacgcgccccccggagcgccgctggccctcaccgcgctccccgaccccgaccccgaacccccaggcacgcccgagatgcaggctccggtcgccagccgtcgaaagccacccagcgccttccgcgagtggaggctgctggggccgttccggagacccacgacccagctgcgcgccaaagtctccagcctgtcgcacaaga

SEQ ID NO: 714 - DNA, 3371 bp, Homo sapiens
  ENST00000620793
aggggcgacgctcttgtctagccgagccgggcagcgctgtcgtccacggtgcgcactgggcgggcagcgctccctctgcccacctcccgccccgtcatggaccaccaggacccctactccgtgcaggccacagcggccatagcggcggccatcaccttcctcattctctttaccatcttcggcaacgctctggtcatcctggctgtgttgaccagccgctcgctgcgcgcccctcagaacctgttcctggtgtcgctggccgccgccgacatcctggtggccacgctcatcatccctttctcgctggccaacgagctgctgggctactggtacttccggcgcacgtggtgcgaggtgtacctggcgctcgacgtgctcttctgcacctcgtccatcgtgcacctgtgcgccatcagcctggaccgctactgggccgtgagccgcgcgctggagtacaactccaagcgcaccccgcgccgcatcaagtgcatcatcctcactgtgtggctcatcgccgccgtcatctcgctgccgcccctcatctacaagggcgaccagggcccccagccgcgcgggcgcccccagtgcaagctcaaccaggaggcctggtacatcctggcctccagcatcggatctttctttgctccttgcctcatcatgatccttgtctacctgcgcatctacctgatcgccaaacgcagcaaccgcagaggtcccagggccaagggggggcctgggcagggtgagtccaagcagccccgacccgaccatggtggggctttggcctcagccaaactgccagccctggcctctgtggcttctgccagagaggtcaacggacactcgaagtccactggggagaaggaggagggggagacccctgaagatactgggacccgggccttgccacccagttgggctgcccttcccaactcaggccagggccagaaggagggtgtttgtggggcatctccagaggatgaagctgaagaggaggaagaggaggaggaggaggaggaagagtgtgaaccccaggcagtgccagtgtctccggcctcagcttgcagccccccgctgcagcagccacagggctcccgggtgctggccaccctacgtggccaggtgctcctgggcaggggcgtgggtgctataggtgggcagtggtggcgtcgacgggcgcagctgacccgggagaagcgcttcaccttcgtgctggctgtggtcattggcgtttttgtgctctgctggttccccttcttcttcagctacagcctgggagccatctgcccgaagcactgcaaggtgccccatggcctcttccagttcttcttctggatcggctactgcaacagctcactgaaccctgttatctacaccatcttcaaccaggacttccgccgtgccttccggaggatcctgtgccgcccgtggacccagacggcctggtgagcccgcctgcgctgcccctgtggggttggtgcggtggcgccggggtcaccctgcttcttgccctgctgtgtgtggctgcctcccctgggctttctgctccctgcccagatcctgtaggcctcatcttaggaaccccttgggaggggtgggcaggggggctgctagcaagggtcccagtgaagcttccccttgccggcttagctgtgggggaccccttctccaccctctccctgagcacaggccgatggaggtggttcaaatcctctggaacatagccaagaccaggagaagagagagcactttcttcccagagccccatgctctccagaccaatgtctgggcttccctttcttgaggaccttgtgttcctggcaggtcacttgcttgtggtgttttcgtttctttttcatctcccccccacccacaaagagcacggagccagccttccacttttcccagtggggcctgctgctgagggggaggaagaaacgaagactgatcacccacgctaggcactcgcggtccctggcaggcgctgggatgggggcttatggggtggcatcgtctctgggccctcctttccccctttgcctgttttcggatctgtggttcctttgaaagccagaacaatggatcggcttccttacccagcacccctccggtaggtgggtggccacgtggatgcctcgctggggcggtcttggaggcctggtctctgcctcgacgggagatccccgatcactggcattcaccccctgcaaaaatcggggcgacaatagctcactgcctacttgctgcagggagatgaaaggctttgcagaaagctttgagctctgtgggggaacacactagagaaccaaaaatgtgattatatggtgatataaaaatccctttcctctgtgtttaccaccacctgtcttcctgtagacttttgttctgtccctggggtgtgtgaattcctaccccgaactggaagccgggagtggcagacagaatcactatttcaagttaaaggatctctttgagaatgtgttcttctggctgcaaaggtctgagttattacgctacatgacaacgtttcgacatttcaccggcaacaccaagagggtttttagtggcttgggtctccccagtgggggataagtcttttgtcatcaaggaggcaaattgtctccccaagacagctcaaaatatccacacctcggcaacagtctaagatgagagcctgtgacaggtggcagcgcccccaggtggggtactggcatcagagcctggtgcgcccctaggggagcctcccactggagtgcccggccaggtctccaagccccaaatgagtccttgtgaaccacaactgatccccccaggtgggtgcttgtggactgcctcggacccagccacgctgctccccgcaatgctgatggggctgtgcattgaggacccctgcttcctggttctcagtcccaccccaaaacctggcacccagaacagttggaagtgtggaaaggaggtttatcggccttcccttggagagggcctggcttcaacattgggccagtaggcatcttagcttggcaggtgtcgggggaatgggccagatggacctgctagatttggaagggcaccgagggagttttctgggtgtagagagaatggaggggaccaaaaagagtccttcctggggtgtgggaggcttcccagcttggtcctcagtgggttgttgaggccagagtatcgccctgggatgtggtggggagctgggccaggagagggactgactgtgaccctctgctggccggtcttgtgtgcgccccatgggacccccagtgttcttgcctgtgacctcttattgcgacatgcaggtggtgttttttttttttttaaactctgagctattttatcaataaaggatattttgtaataag

SEQ ID NO: 715 - DNA, 3443 bp, Homo sapiens
  ENST00000305988
cccgggttcaagagattctcctgtctcagcctcccgagtagctgggactacaggtacgtgccaccacacctggctaatttttgtatttttagtagagacaagagttacaccatattggccaggatcttttgctttctatagcttcaaaatgttcttaatgttaagacattcttaatactctgaaccatatgaatttgccattttggtaagtcacagacgccagatggtggcaatttcacatggcacaacccgaaagattaacaaactatccagcagatgaaaggattttttttagtttcattgggtttactgaagaaattgtttgaattctcattgcatctccagttcaacagataatgagtgagtgatgccacactctcaagagttaaaaacaaaacaacaaaaaaattaaaacaaaagcacacaactttctctctctgtcccaaaatacatacttgcatacccccgctccagataaaatccaaagggtaaaactgtcttcatgcctgcaaattcctaaggagggcacctaaagtacttgacagcgagtgtgctgaggaaatcagcagctgttgaagtcacctcctgtgctcttgccaaatgtttgaaagggaatacactgggttaccgggtgtatgttgggaggggagcattatcagtgctcgggtgaggcaagttcggagtacccagatggagacatccgtgtctgtgtcgctctggatgcctccaagccagcgtgtgtttactttctgtgtgtgtcaccatgtctttgtgcttctgggtgcttctgtgtttgtttctggccgcgtttctgtgttggacaggggtgactttgtgccggatggcttctgtgtgagagcgcgcgcgagtgtgcatgtcggtgagctgggagggtgtgtctcagtgtctatggctgtggttcggtataagtctgagcatgtctgccagggtgtatttgtgcctgtatgtgcgtgcctcggtgggcactctcgtttccttccgaatgtggggcagtgccggtgtgctgccctctgccttgagacctcaagccgcgcaggcgcccagggcaggcaggtagcggccacagaagagccaaaagctcccgggttggctggtaaggacaccacctccagctttagccctctggggccagccagggtagccgggaagcagtggtggcccgccctccagggagcagttgggccccgcccgggccagccccaggagaaggagggcgaggggaggggagggaaaggggaggagtgcctcgccccttcgcggctgccggcgtgccattggccgaaagttcccgtacgtcacggcgagggcagttcccctaaagtcctgtgcacataacgggcagaacgcactgcgaagcggcttcttcagagcacgggctggaactggcaggcaccgcgagcccctagcacccgacaagctgagtgtgcaggacgagtccccaccacacccacaccacagccgctgaatgaggcttccaggcgtccgctcgcggcccgcagagccccgccgtgggtccgcccgctgaggcgcccccagccagtgcgctcacctgccagactgcgcgccatggggcaacccgggaacggcagcgccttcttgctggcacccaatggaagccatgcgccggaccacgacgtcacgcaggaaagggacgaggtgtgggtggtgggcatgggcatcgtcatgtctctcatcgtcctggccatcgtgtttggcaatgtgctggtcatcacagccattgccaagttcgagcgtctgcagacggtcaccaactacttcatcacttcactggcctgtgctgatctggtcatgggcctggcagtggtgccctttggggccgcccatattcttatgaaaatgtggacttttggcaacttctggtgcgagttttggacttccattgatgtgctgtgcgtcacggccagcattgagaccctgtgcgtgatcgcagtggatcgctactttgccattacttcacctttcaagtaccagagcctgctgaccaagaataaggcccgggtgatcattctgatggtgtggattgtgtcaggccttacctccttcttgcccattcagatgcactggtaccgggccacccaccaggaagccatcaactgctatgccaatgagacctgctgtgacttcttcacgaaccaagcctatgccattgcctcttccatcgtgtccttctacgttcccctggtgatcatggtcttcgtctactccagggtctttcaggaggccaaaaggcagctccagaagattgacaaatctgagggccgcttccatgtccagaaccttagccaggtggagcaggatgggcggacggggcatggactccgcagatcttccaagttctgcttgaaggagcacaaagccctcaagacgttaggcatcatcatgggcactttcaccctctgctggctgcccttcttcatcgttaacattgtgcatgtgatccaggataacctcatccgtaaggaagtttacatcctcctaaattggataggctatgtcaattctggtttcaatccccttatctactgccggagcccagatttcaggattgccttccaggagcttctgtgcctgcgcaggtcttctttgaaggcctatgggaatggctactccagcaacggcaacacaggggagcagagtggatatcacgtggaacaggagaaagaaaataaactgctgtgtgaagacctcccaggcacggaagactttgtgggccatcaaggtactgtgcctagcgataacattgattcacaagggaggaattgtagtacaaatgactcactgctgtaaagcagtttttctacttttaaagacccccccccccaacagaacactaaacagactatttaacttgagggtaataaacttagaataaaattgtaaaattgtatagagatatgcagaaggaagggcatccttctgccttttttatttttttaagctgtaaaaagagagaaaacttatttgagtgattatttgttatttgtacagttcagttcctctttgcatggaatttgtaagtttatgtctaaagagctttagtcctagaggacctgagtctgctatattttcatgacttttccatgtatctacctcactattcaagtattaggggtaatatattgctgctggtaatttgtatctgaaggagattttccttcctacacccttggacttgaggattttgagtatctcggacctttcagctgtgaacatggactcttcccccactcctcttatttgctcacacggggtattttaggcagggatttgaggagcagcttcagttgttttcccgagcaaagtctaaagtttacagtaaataaattgtttgaccatgccttcattgcacctgtttctccaaaaccccttgactggagtgctgttgcctcccccactggaaa

SEQ ID NO: 716 - DNA, 6732 bp, Homo sapiens
  ENST00000305428
gccctgcgcccggggcgcctcggagaactgacctgaagtttcagtgtagtcagagagctcttcaagtaataaatcatggagaccagtcaggaaacttccctcttcttggtgaagatcttggaggaactggacagcaagcaaaataccgtttcttatcaggacctgtgcaaatctctctgtgcccggttcgacctgtcgcagcttgccaaactgagaagtgtgctcttctacacagcttgtctcgatcccaattttccagccacgctattcaaagacaagatgaaatgcactgtgaataaccagcaatcaaagaaaatcatggtggcagcagatattgtgacgatattcaacctgatccaaatgaatggcggggctgccaaggagaagctgcccacgggccgccagaaggtacgcaagaaggaggcatcctttgaatcatgtaggtcggacacagagatctgcaatgcagctgagtgtgagcccctgaactgtgagctgagtgagaggtctttcagccggggctaccccatcaggcagtcgtccaagtgccggaagatggactgcaaggactgcccacagtttgtccctgcctctgagcctaacttcctgttgggagttagcaaagaggtgaaaaaccgcgccgcttccctggacaggttgcaggccctggctccgtactctgtgaccagccctcagccctgtgagatgcagaggacctacttccccatgaacatcgaaaacgagtccatttcagaccaggactccctgcccatcaatcagagcatcaaggagaccttcatttccaatgaggagccatttgtggtccagtcctgtgtccagaaaaggaatatcttcaaagaggattttcacaatttgatggcagtgtcccccagtttggttggccccatcagcaaagcagagaatgagcacagggaaccccagagtcgaaaggaaccccacaagccacccttcttcaaccacagctttgaaatgccctataacagccagtacctgaatccagtgtattccccggttcctgacaaaaggcgagcaaagcacgaaagcttagatgaccttcaagcctctacatattttgggcccactcccgtgatgggaacccaagaagccaggcgctgtctagggaagcccaacaagcagactccctggccagccaaaagctggagcctaaacacagaggaagttcctgactttgaacggtcctttttcaatagaaatccctccgaggagaagctacactatccaaatgccagtagccagacccccaatttcccagccccagaaaggcgcccaacttaccttgtgccaaaggatcaacagccaattctccccattgcttatgcggcaaaacaaaatgggctcaaatctaaagagatctcatcccctgttgacctggagaagcatgaaccagtcaaaaagtttaaagacaagagcattaactgcaccagtgggcagctcagctcagacaccagtagcgtgggcacccagactgagcacgtgctggagcccaagaaatgcagagacctgtgcacctctggtcagggcaagtacagtgacaggcacaccatgaagcactcagacgatgactcagaaattgtcagcgacgacatcagtgacattttccgatttcttgatgacatgagcatcagtggctccacgggagtgatacagtcgtcctgctacaacagcacaggatccttgtctcagctccataagtcagactgcgacagttcccctgagcacaacttaaccaaaattgccaatggggtccccaacagcaagggagacaagggcaaccggcctgaaaacacccaccactcggaagaagagctgaagaccagtgtgtgcaaactggtgctcaggattggcgaaattgaacggaagctggaatccctgtcgggtgtccgtgatgaaatctcccaggtcttgggcaaactaaataaattggaccagaaaatgcaacagcctgagaaggtgagtgtgcagatagatctgaactccttgacaagcgagggtccgtctgatgacagtgcctctccccggatgttccacgcacacagtggctcccacggacccaaactagagaacaaccctgactggtgctgctctgatgctagcgggagcaacagtgaaagcctgcgggtcaaggccttaaaaaaaagcctcttcaccaggccatcctctaggtccctaacagaggagaacagtgccacagagtccaaaattgccagcatctccaactcgcccagagactggcgcaccatcacttataccaaccgtgtgggcctcaatgaggaggagataaaagacacaggcccaggagataataaagactggcatcggaaatctaaagaggcagacaggcagtacgacattcccccacagcaccgactgcccaagcagcccaaagatggcttcctggtggagcaggtgttcagccctcacccctaccctgcctccctcaaggcccacatgaagagcaaccccctgtacacagacatgcggctgaccgagttggccgaggtgaagcggggccaaccttcttggaccattgaggagtatgcacggaatgcgggcgacaagggcaagctgacagccctggacctgcagacgcaagaatctttaaacccaaataatttagagtactggatggaagacatttatactccaggatacgattcattactaaaacgtaaagaagccgaattcagacgagccaaggtctgcaagatagctgctctgatcgctgctgcggcatgcaccgtcatcctcgttattgtcgtgcccatctgcacaatgaaatcatgagctaagaatgcaaccttacgtacagcttatgactaccaatgtcgtcgtctgtatcttagaatcttgcagcagtgaggcaacaatttgttgaaatggagatgaaatcatggaggcatttctacaaatgttgaatgaaggtggttttcagaaagtatacattctagtgagaaatctacctacctattagctttgactcaattacactctgacgcatttttagaagtgcaatatcttttcctaccaaaagaacatcatggactatcaataaatacaaattgaatattccaagccaaaaaaggaagattaattgggttctttccattttgatgatgtttcatggtggggaataagttatacagaagatatttaatacacgcctctttagaagaaactaagggaaatagcaacataagaagaaaagaggtggcttctcttttccataatgttcttagaccattgctggtgaagtaacagggtgtgtgtccctaaagggtattacttctctgtcgacttttatcaagggctactgacgtttcattcttgcccttttgtcatcaacacgacagagtgtctgcatcactgcagatcttcatggaaacattctggaccttcttccttgcacttggagtgagaaggagctggactaccaagtcaggcgtggaatgaagtatgctcagactgcatgatgggccaaggtattcaggccaggagacctcgtcctcaatccaaagtgtaggggagctgcctgctaacgatgtaaggtcagtatttgaaaatcatggccactccaaaggatctcctgttcttgctttggtgtgtggctccattccttgattttctatctcctggtggtaccagatgctctgcctctcatacatgagttgaagagtttggaacttgtccttgtgccttgaagagtagagacaatggctaaacgttgacattctatctgtaaaccatggttttcacgcaccactaatatctgccattttcaatggctttaaaaagattttgaaagcttgctcaataatgttcaataatataataataataaaggcactgaggtcttctcagttaccccaacacctactccagagttttgaatacttgtcagcagtgcaaaaaatattatctgtttaaccacttatctatatgtctatctatctatctatatgtctatctatctatctaaatacttgatttttatttattgtcttctctgttaaataacttgagagcaaggtttctttcgtgtaaaagaagctgttgtaatttcatccaaatttgatctgtttccacctgctgaatggtgctctgacaataatggaacagaaagaatccttatcagcatctgattccaatgtcttgttacaggtcaaagaaaaaaggattgacagaaactagctaccttatatatattttttgataataaggtgggatataaatagattttggtagcaagtgtaatcactccgtatgatataataaatttctaaaagatttgagagcatctcaatttttaaagcaataggagtctagcatccattctgaaaaatcgcaaataatgcttagcttgctgtgtctgattctgttgttcaccattaaggggtagacagttaattttattatgttaacaagtgagggatgaatgttttcatctgtggtgaacctttatttttagaagtcttcatgttatctatttgtattatcatgtttatgtatggattttcaatttcagtaaccgaaaacttaagccttagtatgaaaaactgaggatttataattgaaaatgaaaaaaatatgttactctctatcatcagaattatagtctttggtgctctgttttcaatggggcatattacataaggttgtttctttcaccccaaagagactactaggttaccactctgggcattgcctttccacctaacccctcaaccagtaagactctacaccatattgtagccccactattctcctctttatcacagatgaagtgccagagcatcagagataggtagctcccaacctcttgctctggatttgcagaagagggggagatgtacttacccaggataagaaaaatctagtcaaatccaccccaaatcttccatttaacaggtaggaccatcgaggctggaccaaaccactttttccactgcccttggtgaatctattcctagtggaccccatttgggcatgtgcctagctaccttgggaaggcatgactataagtcacacctcaggcttggaaatgaaaggattctatagaatattctatactttccatagctggagaggtagtcagaaattcagtcttgctctgagtccacagtagctttaaaattcaactcaacattgttgtcacgtaacggaaacatctagacctggtaataatccaggaaattgcaaaatggaggccaaaagtaaggtgggtttctctggaaaggggtcatcctcagtctgataataccaagtctgacgctgaggttatgaatcattaccatggcttggagctattggatgcttggggtcttgggatagatagaaggtgaggttcacagttggagcttttcttgccattgaccccaagctcaccccagccttccttccctgaccctgagactcaccctatctatctcccctattccctcagtttgcagaatgagcaagatagagtctggctaggagggaaacatctatccatctctctaatctttgcccatcacctcctgttgcaatgagttcccgcaggtgacatacggactggcctctctactgtactgggtgccatctcccaccatactctggcatttttatgtaaaggataatttcttgtacctgagtctaaaattacaacgttatcaaaattcacttcgtttttcctgcattttaaaagtaataaaatattatttgagattattttgaaattaaatatccttaaccaatgattaaattcataatcatttcatcttctttcataatcatttcatcttctaatctgaatttgttttgaacacagccttgcagaaaagcaaaaaatatttccccgctcaaattttgccgacattttataccagtatccccttcattacagtaaactaaatcataacttacatcatccattactagctgatcataaattgttagtattttaaggtatgcaactatgtgattgacatctgtaaggctagtttaatagacgtgctaaatatcactgttctgaatatctgtgccatagttctgatacccttattggaatcaaggcagtgctgtttctgtttacaagttatcaagataagagcagtggcatcacatttgttgttgttgtttttttttttgaaatagaaaaaaacagaagaagctctgccaacaataaaagattttgttaagtggtataaaaatttgtgaatgttgaaattcaacatgcttcatattataaccaacctgcaagaatattgtggtcaattgtgtgaataccaaatcagtatatactgtatactgtactatgaaaatttgtatttaaaggcaaagatacaagtaattgttggtataattggggaaaagggtattcaatatttattaagtaacaatgagaaatgcaacaaacttccttatttatgccttatgaataaaagagtgtggaatgtaaggtgaaattttatgtgcaagatcctgaaggaatgggtattcttgaaggcagggactgtcttttctatgtttgttctgtacagctctcagcacactcttggtgcttgataaatgttatgttatataataccaataactaagcacatttttagatcttttttcaaatggcttgtgtaaaatttggttaatgtacaatggttggtttgaagctatcatgtaaaattggcctctccaaatataatcagaaataaaccg

SEQ ID NO: 717 - DNA, 5629 bp, Homo sapiens
  ENST00000559272
agaactgacctgaagtttcagtgtagtcagagagctcttcaagtaataaatcatggagaccagtcaggaaacttccctcttcttggtgaagatcttggaggaactggacagcaagcaaaataccgtttcttatcaggacctgtgcaaatctctctgtgcccggttcgacctgtcgcagcttgccaaactgagaagtgtgctcttctacacagcttgtctcgatcccaattttccagccacgctattcaaagacaagatgaaatgcactgtgaataaccagcaatcaaagaaaatcatggtggcagcagatattgtgacgatattcaacctgatccaaatgaatggcggggctgccaaggagaagctgcccacgggccgccagaaggtacgcaagaaggaggcatcctttgaatcatgtaggtcggacacagagatctgcaatgcagctgagtgtgagcccctgaactgtgagctgagtgagaggtctttcagccggggctaccccatcaggcagtcgtccaagtgccggaagatggactgcaaggactgcccacagtttgtccctgcctctgagcctaacttcctgttgggagttagcaaagaggtgaaaaaccgcgccgcttccctggacaggttgcaggccctggctccgtactctgtgaccagccctcagccctgtgagatgcagaggacctacttccccatgaacatcgaaaacgagtccatttcagaccaggactccctgcccatcaatcagagcatcaaggagaccttcatttccaatgaggagccatttgtggtccagtcctgtgtccagaaaaggaatatcttcaaagaggattttcacaatttgatggcagtgtcccccagtttggttggccccatcagcaaagcagagaatgagcacagggaaccccagagtcgaaaggaaccccacaagccacccttcttcaaccacagctttgaaatgccctataacagccagtacctgaatccagtgtattccccggttcctgacaaaaggcgagcaaagcacgaaagcttagatgaccttcaagcctctacatattttgggcccactcccgtgatgggaacccaagaagccaggcgctgtctagggaagcccaacaagcagactccctggccagccaaaagctggagcctaaacacagaggaagttcctgactttgaacggtcctttttcaatagaaatccctccgaggagaagctacactatccaaatgccagtagccagacccccaatttcccagccccagaaaggcgcccaacttaccttgtgccaaaggatcaacagccaattctccccattgcttatgcggcaaaacaaaatgggctcaaatctaaagagatctcatcccctgttgacctggagaagcatgaaccagtcaaaaagtttaaagacaagagcattaactgcaccagtgggcagctcagctcagacaccagtagcgtgggcacccagactgagcacgtgctggagcccaagaaatgcagagacctgtgcacctctggtcagggcaagtacagtgacaggcacaccatgaagcactcagacgatgactcagaaattgtcagcgacgacatcagtgacattttccgatttcttgatgacatgagcatcagtggctccacgggagtgatacagtcgtcctgctacaacagcacaggatccttgtctcagctccataagtcagactgcgacagttcccctgagcacaacttaaccaaaattgccaatggggtccccaacagcaagggagacaagggcaaccggcctgaaaacacccaccactcggaagaagagctgaagaccagtgtgtgcaaactggtgctcaggattggcgaaattgaacggaagctggaatccctgtcgggtgtccgtgatgaaatctcccaggtcttgggcaaactaaataaattggaccagaaaatgcaacagcctgagaaggtgagtgtgcagatagatctgaactccttgacaagcgagggtccgtctgatgacagtgcctctccccggatgttccacgcacacagtggctcccacggacccaaactagagaacaaccctgactggtgctgctctgatgctagcgggagcaacagtgaaagcctgcgggtcaaggccttaaaaaaaagcctcttcaccaggccatcctctaggtccctaacagaggagaacagtgccacagagtccaaaattgccagcatctccaactcgcccagagactggcgcaccatcacttataccaaccgtgtgggcctcaatgaggaggagataaaagacacaggcccaggagataataaagactggcatcggaaatctaaagaggcagacaggcagtacgacattcccccacagcaccgactgcccaagcagcccaaagatggcttcctggtggagcaggtgttcagccctcacccctaccctgcctccctcaaggcccacatgaagagcaaccccctgtacacagacatgcggctgaccgagttggccgaggtgaagcggggccaaccttcttggaccattgaggagtatgcacggaatgcgggcgacaagggcaagctgacagccctggacctgcagcacgtgggataagcatatttgtgggagccaagctatggattatgtttccatacggagcagccccagacgcaagaatctttaaacccaaataatttagagtactggatggaagacatttatactccaggatacgattcattactaaaacgtaaagaagccgaattcagacgagccaaggtctgcaagatagctgctctgatcgctgctgcggcatgcaccgtcatcctcgttattgtcgtgcccatctgcacaatgaaatcatgagctaagaatgcaaccttacgtacagcttatgactaccaatgtcgtcgtctgtatcttagaatcttgcagcagtgaggcaacaatttgttgaaatggagatgaaatcatggaggcatttctacaaatgttgaatgaaggtggttttcagaaagtatacattctagtgagaaatctacctacctattagctttgactcaattacactctgacgcatttttagaagtgcaatatcttttcctaccaaaagaacatcatggactatcaataaatacaaattgaatattccaagccaaaaaaggaagattaattgggttctttccattttgatgatgtttcatggtggggaataagttatacagaagatatttaatacacgcctctttagaagaaactaagggaaatagcaacataagaagaaaagaggtggcttctcttttccataatgttcttagaccattgctggtgaagtaacagggtgtgtgtccctaaagggtattacttctctgtcgacttttatcaagggctactgacgtttcattcttgcccttttgtcatcaacacgacagagtgtctgcatcactgcagatcttcatggaaacattctggaccttcttccttgcacttggagtgagaaggagctggactaccaagtcaggcgtggaatgaagtatgctcagactgcatgatgggccaaggtattcaggccaggagacctcgtcctcaatccaaagtgtaggggagctgcctgctaacgatgtaaggtcagtatttgaaaatcatggccactccaaaggatctcctgttcttgctttggtgtgtggctccattccttgattttctatctcctggtggtaccagatgctctgcctctcatacatgagttgaagagtttggaacttgtccttgtgccttgaagagtagagacaatggctaaacgttgacattctatctgtaaaccatggttttcacgcaccactaatatctgccattttcaatggctttaaaaagattttgaaagcttgctcaataatgttcaataatataataataataaaggcactgaggtcttctcagttaccccaacacctactccagagttttgaatacttgtcagcagtgcaaaaaatattatctgtttaaccacttatctatatgtctatctatctatctatatgtctatctatctatctaaatacttgatttttatttattgtcttctctgttaaataacttgagagcaaggtttctttcgtgtaaaagaagctgttgtaatttcatccaaatttgatctgtttccacctgctgaatggtgctctgacaataatggaacagaaagaatccttatcagcatctgattccaatgtcttgttacaggtcaaagaaaaaaggattgacagaaactagctaccttatatatattttttgataataaggtgggatataaatagattttggtagcaagtgtaatcactccgtatgatataataaatttctaaaagatttgagagcatctcaatttttaaagcaataggagtctagcatccattctgaaaaatcgcaaataatgcttagcttgctgtgtctgattctgttgttcaccattaaggggtagacagttaattttattatgttaacaagtgagggatgaatgttttcatctgtggtgaacctttatttttagaagtcttcatgttatctatttgtattatcatgtttatgtatggattttcaatttcagtaaccgaaaacttaagccttagtatgaaaaactgaggatttataattgaaaatgaaaaaaatatgttactctctatcatcagaattatagtctttggtgctctgttttcaatggggcatattacataaggttgtttctttcaccccaaagagactactaggttaccactctgggcattgcctttccacctaacccctcaaccagtaagactctacaccatattgtagccccactattctcctctttatcacagatgaagtgccagagcatcagagataggtagctcccaacctcttgctctggatttgcagaagagggggagatgtacttacccaggataagaaaaatctagtcaaatccaccccaaatcttccatttaacaggtaggaccatcgaggctggaccaaaccactttttccactgcccttggtgaatctattcctagtggaccccatttgggcatgtgcctagctaccttgggaaggcatgactataagtcacacctcaggcttggaaatgaaaggattctatagaatattctatactttccatagctggagaggtagtcagaaattcagtcttgctctgagtccacagtagctttaaaattcaactcaacattgttgtcacgtaacggaaacatctagacctggtaataatccaggaaattgcaaaatggaggccaaaagtaaggtgggtttctctggaaaggggtcatcctcagtctgataataccaagtctgacgctgaggttatgaatcattaccatggcttggagctattggatgcttggggtcttgggatagatagaaggtgaggttcacagttggagcttttcttgccattgaccccaagctcaccccagccttccttccctgaccctgagactcaccctatctatctcccctattccctcagtttgcagaatgagcaagatagagtctggctaggagggaaacatctatccatctctctaatctttgcccatcacctcctgttgcaatgagttcccgcaggtgaca

SEQ ID NO: 718 - DNA, 7479 bp, Homo sapiens
  ENST00000360265
ctcccagttgaattttgctgccttaaagcagaagcaaaggagtagtgcatttgttaagaagaagacgcctgaatcttttagtggacctgctttcagcaaacttgttttttaggtcagaatactatatccaatgatcaagctaaacatgaaatgcttcgagtaagactcagtattcatactttgacatttgcaaatcactgggtctaataatactcttcctcttttgttgtcagcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacatcctccctcccagaaggttattatgaggaagctgtgccgctgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaagaagaagcacgagctgaagattactcagcagggcacggacccgcttgttctcgccgtccagagcaaggaacaggccgagcagtggctgaaggtgatcaaagaagcctacagtggttgtagtggccccgtggattcagagtgtcctcctccaccaagctccccggtgcacaaggcagaactggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaagatgtaagactttggttcccaactttgttaaaaaacaaaaaaagtgatggaaaggtgtttgaaaggatgctatcaggcgaagtgacatctttctaaccagataggccattgctttcaccgattccaacccagccctggactgaggatggatggttccatgagcccccagatgaaaacctggattcgacagggaagagcttggatccccggctgccccgggcatgagtgtggctggccatgggcactgggctcgccttgcacgcccaccaggagggccaggggcatacgcagtcctgacgtggactttgtgtcttggcgtaccctctccacgtgcccgtccccctcgtcatcagaggtaaaggcatgagaaaatcgcgctgtgaaacgttttttaccttttattattattttttggacagatgcttttgtcaccaagacatgaaaagctgccattcttcttaacctgttttttaggaatgtctttttactgtgtgtcacacttagatcaaggagttttcagaggttccttattttattaattaattatttgtgctgcttttgacaggtagcagagggttttaatacttcactaacagtacaccctcctcccccttgggctagcatccccagcccttaatccacgtcggagccggcaggtgcttctcacaccaggagcctctgggggcaggggctggctcctcgccgctgtacaggacgtttactgctgcttggggccagggcagtcctttgaaagggaagcaagttccggaatttgttcgctcatggaactataacaccttagagcaagaggcaggaattccagggcctcctgcccctccccttcctccagcttgtcaagttaaaccactaatgtgttggtgggcctggccgtgctgcctctcctgagtagggtgggtgcaagtagggcctctttcccagctttcttgcttgccttctgtgcaatatttcttggagaatttggatgcctaaggcataaaggaaaaaaacagagttcatagtttgagctggtatttaccccctgggtttaaaaatcagattaacttcttggtctcccggaggctgctgtcaggaattctccagtacgggaagatgcagtcacttatgacgaaataagtcacccctgaacgcctccgcaggcagattcatggagaccagtcccagtagcaaccgccccttccccaagcatagaatacagaggtgccatacttggtgtaagccttccttctgtccactgtccagaatgtcctttttcacacagaggaagagatggcgggaaaacactgactgactccttgggtttcccccagacatactttcagagcgctagctgtgtggtgcacgggactttacagttaggattcatgtttaaggtggtggcgcttgaggcctgcaagggccacgttggattactgaagcggaaagcggtctcccatgtataagaaaaagttttacaacacgaattggaagctgcttgagtccacctgaacttgaattgattgcaaagccatctgctgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacacctcagggccgtccgctgcattgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacactcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccaacggcacagctgattggtgctcgactcccagcatgcatattttgttgtaaaaacccaggtttgtaattcacatccacaaccctaagccttttaaagcggaggcaaacgttaacaaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaatttatatctgtacatattagacacacgcgagccatcttgccagaattctgacagtgatgtcattttattcccctcccaaaacatgccccaggaacaagcaccccttgcctctgtggcagctgcgagtgtgtctgatttcataacgaagccaggctgagggcaagaggcccgacaggcaggccagggtccccggagaagccggatttcttcgcaatgtcactggtacttagcagatggtcgtgttcacaggggctagccacctgtactacggtgccgaccgcaatgcgaggaatgtggtggccacgcgatggagctggccggaggacaggtcaggtgagggggccgacccctgcggggctcagggctccttccattctaaccttgagccacagtgtcactcttcagggctctgctcctggctctattttgttaaggtgtcatcagccttcaacctccatttatatatttttataatgttaagccactgaccaactttttcatagaaacaactatcagattcgagggctccctttgtccccctgacctgggcacaggcatgggcgatggctccctcttcccagaatctgcggggaactggggcaaggcccatctgtctgcaaggctggtagctctctccctcggcttccagagtccacggcagttgcaaggtaaccagtgtggatctgctgagtcaccccaggcaccagacttaccccaggagcatgggccactgtccatggggccttccttgagaccttcccttggggctggcgggcggcggcttaccagctgggtcagtcccatctcgcccctctgtgcctatgccctggcgttgccaggcttaaccttcccctgtatcttactcatcccagaattattactggccatttctaaatagacaaaaactaccctaaaatgtggagatttactccttttgaaaagtctgtttcaaaaagtgtggcctcagctctggaggccacccccaggaaggagtttgaggttcattgtcattatggccacagtttggtgcttgtgcacgggactcaaagggcagcgtcgaagctggggttaggtgtagggttgtgagcaaagctcccctgtttgtggccacaccttccctttccaaaaaggctattaattctactcacccactatttggggggatgtaaattttgcccacagactttgccacccaggtgaggtgctgtgttcatgcacggaactgatgtcattagacaccatccaaggatgggcagcctgcagtgtggccggcgactgccatccagagaaaaggcaccttgtgccacagggcggggccgacaccctgagctcacaggtggcccctgcattcaggtggatgtccatccttgaaacagcctcttctgggaacacagcactggaggtctccaggcatcagggttggccggcagggtgccctgcagcttacataaaggtcgtggcaatgtttcaatgttaaactaaactattgccttcctcttacttttcctaaaatgattttctaatgggaacagtcacttcaagttcatgacatagtttgaaggaggataattcattttttcctggttgtcactgtcttcttatccccttggtgggctgggttcatactgtgaaataaactaaaatgaaaccaaaacgttcctgccgtaaatacgtggcacagcactgcagaaaaagcagtcacctctattcgtgagtccccaagccatagcagggcgtctgtaaaagaagggaaactgcacccaggaagtggtgggcgtcagacgcatcctttcgcccgtagttcatgaaatagttccggctttggtcttccagaaaatctcaacttcaccgtgcacaagtgttaccgggtctttttagtgtagccatggaagatactttcaaaaggacatcttcagatcataagtcttaggaccaaaggtgtttttaatgagataatctttttgattttctaacaagaaaggaaatattcactttacattttaacatcaacttttaagtgatattcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattcataaagtaaaaattttatgaaaagaaacttgcaaggaaaatcctagttttcagtccactcgccccactttgtagtagcttcactgaatttcctgctttcctggttgaattttctactgtttcacgtggtgtaaccctagactggcgcccttggcgtgcccctttgtgtatgaataaacttctctccccca

SEQ ID NO: 719 - DNA, 1517 bp, Homo sapiens
  ENST00000505447
gggtagtcagctgcctgcgccagcttggttagcatttgtggtctgccagtagaaaggggccacttctgcagtgttccagcggaacacatcctacagagcctctgccgtaccctccttagccattccccagaatcccagcagcccagtgtttggaaaccatcttggttttctttcactttcgatttttcctccatctatgccagtttctacaatacttagagactgaaagaaatgactccagaaaaaaaaaagaccaagatttgtttgactttgtgtttatttttaatgttcttatatgtttatttcaacagctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaagatgtaagactttggttcccaactttgttaaaaaacaaaaaaagtgatggaaaggtgtttgaaaggatgctatcaggcgaagtgacatctttctaaccagataggccattgctttcaccgattccaacccagccctggactgaggatggatggttccatgagcccccagatgaaaacctggattcgacagggaagagcttggatccccggctgccccgggcatgagtgtggctggccatgggcactgggctcgccttgcacgcccaccaggagggccaggggcatacgcagtcctgacgtggactttgtgtcttggcgtaccctctccacgtgcccgtccccctcg

SEQ ID NO: 720 - DNA, 1638 bp, Homo sapiens
  ENST00000513842
gtgcagaccctgaccacggccaaagcttttgttctctctcagcttctttacccaccgtaaaacacgaatgctgagctagagtcagtgtaccttgtaaacatttatgtaggctgaaaactggagggtggatggcggtggaaaaaagctgaaaacttaaataaagaaactgtactcttgatgtaacaatgcgggtctcccatgagagctctgacagcagatctgagaagggttgcaaggagaaggaggcatgaattggcacgggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgtgggaaccggaagacggctttcctgcttcctgcagcagaggcttgggagaagaggtgctttatgataacgcaggcctgtacgataacttgccgcctccgcacatctttgcccgctactctcctgctgacagaaaggcctctaggctgtctgctgacaagctgtcctctaaccattacaaataccctgcctccgctcagtctgtcactaatacctcttctgtggggagggcgtctctcgggctcaactcgcagctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaag

SEQ ID NO: 721 - DNA, 2590 bp, Homo sapiens
  ENST00000382543
agcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacatcctccctcccagaaggttattatgaggaagctgtgccgctgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaagaagaagcacgagctgaagattactcagcagggcacggacccgcttgttctcgccgtccagagcaaggaacaggccgagcagtggctgaaggtgatcaaagaagcctacagtggttgtagtggccccgtggattcagagtgtcctcctccaccaagctccccggtgcacaaggcagaactggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgtgggaaccggaagacggctttcctgcttcctgcagcagaggcttgggagaagaggtgctttatgataacgcaggcctgtacgataacttgccgcctccgcacatctttgcccgctactctcctgctgacagaaaggcctctaggctgtctgctgacaagctgtcctctaaccattacaaataccctgcctccgctcagtctgtcactaatacctcttctgtggggagggcgtctctcgggctcaactcgcagctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtg

SEQ ID NO: 722 - DNA, 546 bp, Homo sapiens
  ENST00000508415
agacatgggcaggtggattgggattttactcgcagagacgggatcgtccacagacccggaggctctgcactatgactacattgatgtggagatgtctgcaagtgtcattcagacagccaaacagaccttctggtcctgccagatgagcctgtcagaggcatcctgcagtggctcttcccagcacagaagcaggagtggagccccccagggcctctgttctgaccccatcctttgtccctgctgcagcagggtgagtgcagggcatatgctggaaactgaagatgcaagcccgtgagagacgtgcctgccgctggaaggagaaagacccaaggcagtacggcccagggcacaggggaggggatggtccctgtggccaggctttattcattcctccatttactgcctctcgctgacagaaagtatacatagcgctgtctccctaaaagccttccaatgaggcatttaattagaaaaccttaaatatgtattttttaaaaatcaaaatcttttactgtggaactcttaaatgttcaagttttgctgtgc

SEQ ID NO: 723 - DNA, 356 bp, Homo sapiens
  ENST00000614385
ggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggtaagactgcgcttcccggagacgagcagcgtgcacctaagtgggtttcattttctcctgcagtggtgtcggtacccagttcatccaaggctcgttaatttgagctcttttgcattggacttggaatcattcagatagtgggaaatgtattaaatgtttacatttttgcctctta

SEQ ID NO: 724 - DNA, 764 bp, Homo sapiens
  ENST00000513856
gcttaggctggagtgcagtggcatgatcacagctcactgcagccttgacctcccaggctcaagtgatcctcttacctcagcctcccgagtagctgggactacagatgtacaccatcacacctggctaatttttgtattttttgtggagacggggtttttccatgtttcccaggctagtcttgaactcctgggcttaagtgattctcccacctcaccctcctgagtagcggggactacagatgtgagccaccacactcggcctgaaacagtgaagttttgataccaggcgttaccatcttcccatcgatgcatttcgccctttctcagcctcctgacagtgggcctccaccattgccaacatcctccctcccagaaggttattatgaggaagctgtgccgctgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaagaagaagcacgagctgaagattactca

SEQ ID NO: 725 - DNA, 758 bp, Homo sapiens
  ENST00000612691
cccttggttgcatattgagtgtcagagatgttgtgcacgtggggatgccagcagggagaagcagattgcagccttgggaggtctttgacataaagattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctggtaagacatttggaatcgcttgcattttttgtaagattgctgcactcagaagccatggcgtttatatccagtcaccattaacatcagctgtgcaggaagggcagcactcaggtgtcagccaggtgccctgagctagccgcagtaccatgccaggggcccccacatgccatcagggagcactcgcccgtgttgtgtgttcaaggttgccggtttcccagctccaaaagcagccagcgaacaaaatcattcccattcccgggcagggcctgtggtttgcgtctgtggaaatgcacaagattttaacttgccaggagttgcaagatggattttctcatttgtagtgagtcagtggattcctcaaagccagctcatagaagtgggacggggagcagccaggaaaggaaattcttctggaaagcttggggccaattcccatttttttttttttttt

SEQ ID NO: 726 - DNA, 7516 bp, Homo sapiens
  ENST00000358461
gggcgcccggctccgctgggggcgggacggcgggcggcgggcggggccgtgtgcgcctgcgtggtgtctgtcccggccgcagccccacgccggctgcagctccgcgagccgagccggatctcgagcggggtacacgggctgaggcggcggcggcggccccgccccggggctccattgttaaggcggctgcggctctgtcggctgttcagctgcgctccagtcggcccaggcgccgcggcgaggagcgagcgctgcgaggtggcggcctgagcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacatcctccctcccagaaggttattatgaggaagctgtgccgctgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaagaagaagcacgagctgaagattactcagcagggcacggacccgcttgttctcgccgtccagagcaaggaacaggccgagcagtggctgaaggtgatcaaagaagcctacagtggttgtagtggccccgtggattcagagtgtcctcctccaccaagctccccggtgcacaaggcagaactggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaagatgtaagactttggttcccaactttgttaaaaaacaaaaaaagtgatggaaaggtgtttgaaaggatgctatcaggcgaagtgacatctttctaaccagataggccattgctttcaccgattccaacccagccctggactgaggatggatggttccatgagcccccagatgaaaacctggattcgacagggaagagcttggatccccggctgccccgggcatgagtgtggctggccatgggcactgggctcgccttgcacgcccaccaggagggccaggggcatacgcagtcctgacgtggactttgtgtcttggcgtaccctctccacgtgcccgtccccctcgtcatcagaggtaaaggcatgagaaaatcgcgctgtgaaacgttttttaccttttattattattttttggacagatgcttttgtcaccaagacatgaaaagctgccattcttcttaacctgttttttaggaatgtctttttactgtgtgtcacacttagatcaaggagttttcagaggttccttattttattaattaattatttgtgctgcttttgacaggtagcagagggttttaatacttcactaacagtacaccctcctcccccttgggctagcatccccagcccttaatccacgtcggagccggcaggtgcttctcacaccaggagcctctgggggcaggggctggctcctcgccgctgtacaggacgtttactgctgcttggggccagggcagtcctttgaaagggaagcaagttccggaatttgttcgctcatggaactataacaccttagagcaagaggcaggaattccagggcctcctgcccctccccttcctccagcttgtcaagttaaaccactaatgtgttggtgggcctggccgtgctgcctctcctgagtagggtgggtgcaagtagggcctctttcccagctttcttgcttgccttctgtgcaatatttcttggagaatttggatgcctaaggcataaaggaaaaaaacagagttcatagtttgagctggtatttaccccctgggtttaaaaatcagattaacttcttggtctcccggaggctgctgtcaggaattctccagtacgggaagatgcagtcacttatgacgaaataagtcacccctgaacgcctccgcaggcagattcatggagaccagtcccagtagcaaccgccccttccccaagcatagaatacagaggtgccatacttggtgtaagccttccttctgtccactgtccagaatgtcctttttcacacagaggaagagatggcgggaaaacactgactgactccttgggtttcccccagacatactttcagagcgctagctgtgtggtgcacgggactttacagttaggattcatgtttaaggtggtggcgcttgaggcctgcaagggccacgttggattactgaagcggaaagcggtctcccatgtataagaaaaagttttacaacacgaattggaagctgcttgagtccacctgaacttgaattgattgcaaagccatctgctgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacacctcagggccgtccgctgcattgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacactcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccaacggcacagctgattggtgctcgactcccagcatgcatattttgttgtaaaaacccaggtttgtaattcacatccacaaccctaagccttttaaagcggaggcaaacgttaacaaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaatttatatctgtacatattagacacacgcgagccatcttgccagaattctgacagtgatgtcattttattcccctcccaaaacatgccccaggaacaagcaccccttgcctctgtggcagctgcgagtgtgtctgatttcataacgaagccaggctgagggcaagaggcccgacaggcaggccagggtccccggagaagccggatttcttcgcaatgtcactggtacttagcagatggtcgtgttcacaggggctagccacctgtactacggtgccgaccgcaatgcgaggaatgtggtggccacgcgatggagctggccggaggacaggtcaggtgagggggccgacccctgcggggctcagggctccttccattctaaccttgagccacagtgtcactcttcagggctctgctcctggctctattttgttaaggtgtcatcagccttcaacctccatttatatatttttataatgttaagccactgaccaactttttcatagaaacaactatcagattcgagggctccctttgtccccctgacctgggcacaggcatgggcgatggctccctcttcccagaatctgcggggaactggggcaaggcccatctgtctgcaaggctggtagctctctccctcggcttccagagtccacggcagttgcaaggtaaccagtgtggatctgctgagtcaccccaggcaccagacttaccccaggagcatgggccactgtccatggggccttccttgagaccttcccttggggctggcgggcggcggcttaccagctgggtcagtcccatctcgcccctctgtgcctatgccctggcgttgccaggcttaaccttcccctgtatcttactcatcccagaattattactggccatttctaaatagacaaaaactaccctaaaatgtggagatttactccttttgaaaagtctgtttcaaaaagtgtggcctcagctctggaggccacccccaggaaggagtttgaggttcattgtcattatggccacagtttggtgcttgtgcacgggactcaaagggcagcgtcgaagctggggttaggtgtagggttgtgagcaaagctcccctgtttgtggccacaccttccctttccaaaaaggctattaattctactcacccactatttggggggatgtaaattttgcccacagactttgccacccaggtgaggtgctgtgttcatgcacggaactgatgtcattagacaccatccaaggatgggcagcctgcagtgtggccggcgactgccatccagagaaaaggcaccttgtgccacagggcggggccgacaccctgagctcacaggtggcccctgcattcaggtggatgtccatccttgaaacagcctcttctgggaacacagcactggaggtctccaggcatcagggttggccggcagggtgccctgcagcttacataaaggtcgtggcaatgtttcaatgttaaactaaactattgccttcctcttacttttcctaaaatgattttctaatgggaacagtcacttcaagttcatgacatagtttgaaggaggataattcattttttcctggttgtcactgtcttcttatccccttggtgggctgggttcatactgtgaaataaactaaaatgaaaccaaaacgttcctgccgtaaatacgtggcacagcactgcagaaaaagcagtcacctctattcgtgagtccccaagccatagcagggcgtctgtaaaagaagggaaactgcacccaggaagtggtgggcgtcagacgcatcctttcgcccgtagttcatgaaatagttccggctttggtcttccagaaaatctcaacttcaccgtgcacaagtgttaccgggtctttttagtgtagccatggaagatactttcaaaaggacatcttcagatcataagtcttaggaccaaaggtgtttttaatgagataatctttttgattttctaacaagaaaggaaatattcactttacattttaacatcaacttttaagtgatattcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattcataaagtaaaaattttatgaaaagaaacttgcaaggaaaatcctagttttcagtccactcgccccactttgtagtagcttcactgaatttcctgctttcctggttgaattttctactgtttcacgtggtgtaaccctagactggcgcccttggcgtgcccctttgtgtatgaataaacttctctccccc

SEQ ID NO: 727 - DNA, 7768 bp, Homo sapiens
  ENST00000420658
gggcgcccggctccgctgggggcgggacggcgggcggcgggcggggccgtgtgcgcctgcgtggtgtctgtcccggccgcagccccacgccggctgcagctccgcgagccgagccggatctcgagcggggtacacgggctgaggcggcggcggcggccccgccccggggctccattgttaaggcggctgcggctctgtcggctgttcagctgcgctccagtcggcccaggcgccgcggcgaggagcgagcgctgcgaggtggcggcctgagcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacatcctccctcccagaaggttattatgaggaagctgtgccgctgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaagaagaagcacgagctgaagattactcagcagggcacggacccgcttgttctcgccgtccagagcaaggaacaggccgagcagtggctgaaggtgatcaaagaagcctacagtggttgtagtggccccgtggattcagagtgtcctcctccaccaagctccccggtgcacaaggcagaactggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgtgggaaccggaagacggctttcctgcttcctgcagcagaggcttgggagaagaggtgctttatgataacgcaggcctgtacgataacttgccgcctccgcacatctttgcccgctactctcctgctgacagaaaggcctctaggctgtctgctgacaagctgtcctctaaccattacaaataccctgcctccgctcagtctgtcactaatacctcttctgtggggagggcgtctctcgggctcaactcgcagctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaagatgtaagactttggttcccaactttgttaaaaaacaaaaaaagtgatggaaaggtgtttgaaaggatgctatcaggcgaagtgacatctttctaaccagataggccattgctttcaccgattccaacccagccctggactgaggatggatggttccatgagcccccagatgaaaacctggattcgacagggaagagcttggatccccggctgccccgggcatgagtgtggctggccatgggcactgggctcgccttgcacgcccaccaggagggccaggggcatacgcagtcctgacgtggactttgtgtcttggcgtaccctctccacgtgcccgtccccctcgtcatcagaggtaaaggcatgagaaaatcgcgctgtgaaacgttttttaccttttattattattttttggacagatgcttttgtcaccaagacatgaaaagctgccattcttcttaacctgttttttaggaatgtctttttactgtgtgtcacacttagatcaaggagttttcagaggttccttattttattaattaattatttgtgctgcttttgacaggtagcagagggttttaatacttcactaacagtacaccctcctcccccttgggctagcatccccagcccttaatccacgtcggagccggcaggtgcttctcacaccaggagcctctgggggcaggggctggctcctcgccgctgtacaggacgtttactgctgcttggggccagggcagtcctttgaaagggaagcaagttccggaatttgttcgctcatggaactataacaccttagagcaagaggcaggaattccagggcctcctgcccctccccttcctccagcttgtcaagttaaaccactaatgtgttggtgggcctggccgtgctgcctctcctgagtagggtgggtgcaagtagggcctctttcccagctttcttgcttgccttctgtgcaatatttcttggagaatttggatgcctaaggcataaaggaaaaaaacagagttcatagtttgagctggtatttaccccctgggtttaaaaatcagattaacttcttggtctcccggaggctgctgtcaggaattctccagtacgggaagatgcagtcacttatgacgaaataagtcacccctgaacgcctccgcaggcagattcatggagaccagtcccagtagcaaccgccccttccccaagcatagaatacagaggtgccatacttggtgtaagccttccttctgtccactgtccagaatgtcctttttcacacagaggaagagatggcgggaaaacactgactgactccttgggtttcccccagacatactttcagagcgctagctgtgtggtgcacgggactttacagttaggattcatgtttaaggtggtggcgcttgaggcctgcaagggccacgttggattactgaagcggaaagcggtctcccatgtataagaaaaagttttacaacacgaattggaagctgcttgagtccacctgaacttgaattgattgcaaagccatctgctgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacacctcagggccgtccgctgcattgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacactcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccaacggcacagctgattggtgctcgactcccagcatgcatattttgttgtaaaaacccaggtttgtaattcacatccacaaccctaagccttttaaagcggaggcaaacgttaacaaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaatttatatctgtacatattagacacacgcgagccatcttgccagaattctgacagtgatgtcattttattcccctcccaaaacatgccccaggaacaagcaccccttgcctctgtggcagctgcgagtgtgtctgatttcataacgaagccaggctgagggcaagaggcccgacaggcaggccagggtccccggagaagccggatttcttcgcaatgtcactggtacttagcagatggtcgtgttcacaggggctagccacctgtactacggtgccgaccgcaatgcgaggaatgtggtggccacgcgatggagctggccggaggacaggtcaggtgagggggccgacccctgcggggctcagggctccttccattctaaccttgagccacagtgtcactcttcagggctctgctcctggctctattttgttaaggtgtcatcagccttcaacctccatttatatatttttataatgttaagccactgaccaactttttcatagaaacaactatcagattcgagggctccctttgtccccctgacctgggcacaggcatgggcgatggctccctcttcccagaatctgcggggaactggggcaaggcccatctgtctgcaaggctggtagctctctccctcggcttccagagtccacggcagttgcaaggtaaccagtgtggatctgctgagtcaccccaggcaccagacttaccccaggagcatgggccactgtccatggggccttccttgagaccttcccttggggctggcgggcggcggcttaccagctgggtcagtcccatctcgcccctctgtgcctatgccctggcgttgccaggcttaaccttcccctgtatcttactcatcccagaattattactggccatttctaaatagacaaaaactaccctaaaatgtggagatttactccttttgaaaagtctgtttcaaaaagtgtggcctcagctctggaggccacccccaggaaggagtttgaggttcattgtcattatggccacagtttggtgcttgtgcacgggactcaaagggcagcgtcgaagctggggttaggtgtagggttgtgagcaaagctcccctgtttgtggccacaccttccctttccaaaaaggctattaattctactcacccactatttggggggatgtaaattttgcccacagactttgccacccaggtgaggtgctgtgttcatgcacggaactgatgtcattagacaccatccaaggatgggcagcctgcagtgtggccggcgactgccatccagagaaaaggcaccttgtgccacagggcggggccgacaccctgagctcacaggtggcccctgcattcaggtggatgtccatccttgaaacagcctcttctgggaacacagcactggaggtctccaggcatcagggttggccggcagggtgccctgcagcttacataaaggtcgtggcaatgtttcaatgttaaactaaactattgccttcctcttacttttcctaaaatgattttctaatgggaacagtcacttcaagttcatgacatagtttgaaggaggataattcattttttcctggttgtcactgtcttcttatccccttggtgggctgggttcatactgtgaaataaactaaaatgaaaccaaaacgttcctgccgtaaatacgtggcacagcactgcagaaaaagcagtcacctctattcgtgagtccccaagccatagcagggcgtctgtaaaagaagggaaactgcacccaggaagtggtgggcgtcagacgcatcctttcgcccgtagttcatgaaatagttccggctttggtcttccagaaaatctcaacttcaccgtgcacaagtgttaccgggtctttttagtgtagccatggaagatactttcaaaaggacatcttcagatcataagtcttaggaccaaaggtgtttttaatgagataatctttttgattttctaacaagaaaggaaatattcactttacattttaacatcaacttttaagtgatattcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattcataaagtaaaaattttatgaaaagaaacttgcaaggaaaatcctagttttcagtccactcgccccactttgtagtagcttcactgaatttcctgctttcctggttgaattttctactgtttcacgtggtgtaaccctagactggcgcccttggcgtgcccctttgtgtatgaataaacttctctccccc

SEQ ID NO: 728 - DNA, 1289 bp, Homo sapiens
  ENST00000455574
ccgctgggctggcctgagagcgcagcgcgccggccgctaccagccgcgccggagcccctgcgccctgcggcccgctccccggggaccgggccggcgccatggaccgaggccaggtgctggagcagctgctcccagagctcaccgggctgctcagcctcctggaccacgagtacctcagcgataccaccctggaaaagaagatggccgtggcctccatcctgcagagcctgcagccccttccagcaaaggaggtctcctacctgtatgtgaacacagcagacctccactcggggcccagcttcgtggaatccctctttgaagaatttgactgtgacctgagtgaccttcgggacatgccagaggatgatggggagcccagcaaaggagccagccctgagctagccaagagcccacgcctgagaaacgcggccgacctgcctccaccgctccccaacaagcctccccctgaggactactatgaagaggcccttcctctgggacccggcaagtcgcctgagtacatcagctcccacaatggctgcagcccctcacactcgattgtggatggctactatgaggacgcagacagcagctaccctgcaaccagggtgaacggcgagcttaagagctcctataatgactctgacgcaatgagcagctcctatgagtcctacgatgaagaggaggaggaagggaagagcccgcagccccgacaccagtggccctcagaggaggcctccatgcacctggtgagggaatgcaggatatgtgccttcctgctgcggaaaaagcgtttcgggcagtgggccaagcagctgacggtcatcagggaggaccagctcctgtgttacaaaagctccaaggatcggcagccacatctgaggttggcactggatacctgcagcatcatctacgtgcccaaggacagccggcacaagaggcacgagctgcgtttcacccagggggctaccgaggtcttggtgctggcactgcagagccgagagcaggccgaggagtggctgaaggtcatccgagaagtgagcaagccagttgggggagctgagggagtggaggtccccagatccccagtcctcctgtgcaagttggacctggacaaggtatatctgtctccactaagtcttccccaggccaggcagtggccactcaacacgggctcaaccccaggggaactaactggctggggggaaagtcaggcaactgccaaactgtaggtgcccagcacagagctggcacaacagtaggtgcttaataaatgtctcctgaattca

SEQ ID NO: 729 - DNA, 4177 bp, Homo sapiens
  ENST00000296721
ccgctgggctggcctgagagcgcagcgcgccggccgctaccagccgcgccggagcccctgcgccctgcggcccgctccccggggaccgggccggcgccatggaccgaggccaggtgctggagcagctgctcccagagctcaccgggctgctcagcctcctggaccacgagtacctcagcgataccaccctggaaaagaagatggccgtggcctccatcctgcagagcctgcagccccttccagcaaaggaggtctcctacctgtatgtgaacacagcagacctccactcggggcccagcttcgtggaatccctctttgaagaatttgactgtgacctgagtgaccttcgggacatgccagaggatgatggggagcccagcaaaggagccagccctgagctagccaagagcccacgcctgagaaacgcggccgacctgcctccaccgctccccaacaagcctccccctgaggactactatgaagaggcccttcctctgggacccggcaagtcgcctgagtacatcagctcccacaatggctgcagcccctcacactcgattgtggatggctactatgaggacgcagacagcagctaccctgcaaccagggtgaacggcgagcttaagagctcctataatgactctgacgcaatgagcagctcctatgagtcctacgatgaagaggaggaggaagggaagagcccgcagccccgacaccagtggccctcagaggaggcctccatgcacctggtgagggaatgcaggatatgtgccttcctgctgcggaaaaagcgtttcgggcagtgggccaagcagctgacggtcatcagggaggaccagctcctgtgttacaaaagctccaaggatcggcagccacatctgaggttggcactggatacctgcagcatcatctacgtgcccaaggacagccggcacaagaggcacgagctgcgtttcacccagggggctaccgaggtcttggtgctggcactgcagagccgagagcaggccgaggagtggctgaaggtcatccgagaagtgagcaagccagttgggggagctgagggagtggaggtccccagatccccagtcctcctgtgcaagttggacctggacaagaggctgtcccaagagaagcagacctcagattctgacagcgtgggtgtgggtgacaactgttctacccttggccgccgggagacctgtgatcacggcaaagggaagaagagcagcctggcagaactgaagggctcaatgagcagggctgcgggccgcaagatcacccgtatcattggcttctccaagaagaagacactggccgatgacctgcagacgtcctccaccgaggaggaggttccctgctgtggctacctgaacgtgctggtgaaccagggctggaaggaacgctggtgccgcctgaagtgcaacactctgtatttccacaaggatcacatggacctgcgaacccatgtgaacgccatcgccctgcaaggctgtgaggtggccccgggctttgggccccgacacccatttgccttcaggatcctgcgcaaccggcaggaggtggccatcttggaggcaagctgttcagaggacatgggtcgctggctcgggctgctgctggtggagatgggctccagagtcactccggaggcgctgcactatgactacgtggatgtggagaccttaaccagcatcgtcagtgctgggcgcaactccttcctatatgcaagatcctgccagaatcagtggcctgagccccgagtctatgatgatgttccttatgaaaagatgcaggacgaggagcccgagcgccccacaggggcccaggtgaagcgtcacgcctcctcctgcagtgagaagtcccatcgtgtggacccgcaggtcaaagtcaaacgccacgcctccagtgccaatcaatacaagtatggcaagaaccgagccgaggaggatgcccggaggtacttggtagaaaaagagaagctggagaaagagaaagagacgattcggacagagctgatagcactgagacaggagaagagggaactgaaggaagccattcggagcagcccaggagcaaaattaaaggctctggaagaagccgtggccaccctggaagctcagtgtcgggcaaaggaggagcgccggattgacctggagctgaagctggtggctgtgaaggagcgcttgcagcagtccctggcaggagggccagccctggggctctccgtgagcagcaagcccaagagtggggaaactgcaaataaaccccagaacagcgttccagagcaacctctccctgtcaactgtgtttctgagctgaggaagaggagcccatccatcgtagcctccaaccaaggaagggtgctacagaaagccaaggaatgggaaatgaagaagacctaggaagaggatgaggatttcattccaaaggaaataccagcttgtccacctgaggaagaaatgcttttttcacaaggagacaccaagagaagactaggaagtagccctcgttctccagggcacccaaaataccagcctttattgtctgcatgattttaggggatatggggagggaacaagtagaagggaagagggaaatggagagcatccttatgactttacaaagggtggaaatgaggatggagggatacagaagtctgcacagctgtaaaggttttatagatgtctttgccttcccttctgaggaagggaagaagtaatgaaagcacatgtgaataaccccttccatcccattcacagcatcgcactcccagtccttaaggcaaagggaggcagtgctgaagcattggtggtgcagtgtaaagagacaagacctgatcatctgatcacacttgtgccaacttgattcatattgggcattactaacaacccctggtcaaggtaaataggttgaacaatcaataacattatccctgcctgcatacatgtgaacaaaagctatagaggacatgcaaattctacagtcattcctcatatgctttagacagagtgcagctactggaatcttccagatttcagtgttttaaaatcagagctctgaatacacaaaaggaaagagaaatggagcagctgacatattttaagctcacagtgatactcagtgacaggagcacagagctctaatgtccacaggatgttgtagggtagggtctctcagtaaatcaagtcccttacctatgttctgacactgaggctcttggagctatgggttagaaatccaggaggcaatatgtctttattctaatgaagtcctcatcttgcactcagaggcccactagtttgcccttctatatattaagtaaaaccaagagaaattaagaggatgatggcttctttctgtcacatgggtgctaaaccttttacaaacacttgatacttctatagagggaccaaggacctcaagtcctgggcagtctccttactgtgctactcactactgtctcaacactgtagtgagtctgtctttaacacatttccttccaataaagataaaaccacttaactcttaagtgccagtgcttagctcaagaggaaagaaggaaaatcccagaataaccgtggccactttgctataggggttacatattttaacccacctaaggttttacagactttagcctcactcaaactttatcaccctctgaggtagctggagaccacagcaggaaaaataacctgaccagtaatcacccactgattagtggcagagcgtaggacttaggggttataagcccagatccagatagggctaggtttgagccatgcctctaatgaccagctgggtgaccttgggaaagtcacttgattgctctgattcttgttttccttatctgtgaaatgggactaacaattgttacttttctcccaagattgttgggaagatttaataagataatatatagtaggcatcttgcatagtgtctgagaaataagaaatgctcagtcaatagtggctctcattagccaggcatggtggtactcgcctgtagtcccagctactcaggaggctgaggcaggaggaccgcttgagcccaggagtttgagactgtagtgcactatgatcacgcctgtgaattgccactgcactccagcctaagcaaatagcaagaccccatctattaaaaaaaaaaagtggctattattagctatatcag

SEQ ID NO: 730 - DNA, 871 bp, Homo sapiens
  ENST00000522492
gcgcgccggccgctaccagccgcgccggagcccctgcgccctgcggcccgctccccggggaccgggccggcgccatggaccgaggccaggtgctggagcagctgctcccagagctcaccgggctgctcagcctcctggaccacgagtacctcagcgataccaccctggaaaagaagatggccgtggcctccatcctgcagagcctgcagccccttccagcaaaggaggtctcctacctgtatgtgaacacagcagacctccactcggggcccagcttcgtggaatccctctttgaagaatttgactgtgacctgagtgaccttcgggacatgccagaggatgatggggagcccagcaaaggagccagccctgagctagccaagagcccacgcctgagaaacgcggccgacctgcctccaccgctccccaacaagcctccccctgaggactactatgaagaggcccttcctctgggacccggcaagtcgcctgagtacatcagctcccacactgatggaccttgggctgattgcaccttttggctatggtgcttggatcagatggctgcagcccctcacactcgattgtggatggctactatgaggacgcagacagcagctaccctgcaaccagggtgaacggcgagcttaagagctcctataatgactctgacgcaatgagcagctcctatgagtcctacgatgaagaggaggaggaagggaagagcccgcagccccgacaccagtggccctcagaggaggcctccatgcacctggtgagggaatgcaggatatgtgccttcctgctgcggaaaaagcgtttcgggcagtgggccaagcagctgacggtcatcagggaggaccagctcctg

SEQ ID NO: 731 - DNA, 2319 bp, Homo sapiens
  ENST00000515000
ccggagcccctgcgccctgcggcccgctccccggggaccgggccggcgccatggaccgaggccaggtgctggagcagctgctcccagagctcaccgggctgctcagcctcctggaccacgagtacctcagcgataccaccctggaaaagaagatggccgtggcctccatcctgcagagcctgcagccccttccagcaaaggaggtctcctacctgtatgtgaacacagcagacctccactcggggcccagcttcgtggaatccctctttgaagaatttgactgtgacctgagtgaccttcgggacatgccagaggatgatggggagcccagcaaaggagccagccctgagctagccaagagcccacgcctgagaaacgcggccgacctgcctccaccgctccccaacaagcctccccctgaggactactatgaagaggcccttcctctgggacccggcaagtcgcctgagtacatcagctcccacaatggctgcagcccctcacactcgattgtggatggctactatgaggacgcagacagcagctaccctgcaaccagggtgaacggcgagcttaagagctcctataatgactctgacgcaatgagcagctcctatgagtcctacgatgaagaggaggaggaagggaagagcccgcagccccgacaccagtggccctcagaggaggcctccatgcacctggtgagggaatgcaggatatgtgccttcctgctgcggaaaaagcgtttcgggcagtgggccaagcagctgacggtcatcagggaggaccagctcctgtgttacaaaagctccaaggatcggcagccacatctgaggttggcactggatacctgcagcatcatctacgtgcccaaggacagccggcacaagaggcacgagctgcgtttcacccagggggctaccgaggtcttggtgctggcactgcagagccgagagcaggccgaggagtggctgaaggtcatccgagaagtgagcaagccagttgggggagctgagggagtggaggtccccagatccccagtcctcctgtgcaagttggacctggacaagaggctgtcccaagagaagcagacctcagattctgacagcgtgggtgtgggtgacaactgttctacccttggccgccgggagacctgtgatcacggcaaagggaagaagagcagcctggcagaactgaagggctcaatgagcagggctgcgggccgcaagatcacccgtatcattggcttctccaagaagaagacactggccgatgacctgcagacgtcctccaccgaggaggaggttccctgctgtggctacctgaacgtgctggtgaaccagggctggaaggaacgctggtgccgcctgaagtgcaacactctgtatttccacaaggatcacatggacctgcgaacccatgtgaacgccatcgccctgcaaggctgtgaggtggccccgggctttgggccccgacacccatttgccttcaggatcctgcgcaaccggcaggaggtggccatcttggaggcaagctgttcagaggacatgggtcgctggctcgggctgctgctggtggagatgggctccagagtcactccggaggcgctgcactatgactacgtggatgtggagaccttaaccagcatcgtcagtgctgggcgcaactccttcctatatgcaagatcctgccagaatcagtggcctgagccccgagtctatgatgatgttccttatgaaaagatgcaggacgaggagcccgagcgccccacaggggcccaggtgaagcgtcacgcctcctcctgcagtgagaagtcccatcgtgtggacccgcaggtcaaagtcaaacgccacgcctccagtgccaatcaatacaagtatggcaagaaccgagccgaggaggatgcccggaggtacttggtagaaaaagagaagctggagaaagagaaagagacgattcggacagagctgatagcactgagacaggagaagagggaactgaaggaagccattcggagcagcccaggagcaaaattaaaggctctggaagaagccgtggccaccctggaagctcagtgtcgggcaaaggaggagcgccggattgacctggagctgaagctggtggctgtgaaggagcgcttgcagcagtccctggcaggagggccagccctggggctctccgtgagcagcaagcccaagagtggggaatgggaaatgaagaagacctaggaagaggatgaggatttcattccaaaggaaataccagcttgtccacctgaggaagaaatgcttttttcacaaggagacaccaagagaagac

SEQ ID NO: 732 - DNA, 291 bp, Homo sapiens
  ENST00000508444
agccagccctgagctagccaagagcccacgcctgagaaacgcggccgacctgcctccaccgctccccaacaagcctccccctgaggactactatgaagaggcccttcctctgggacccggcaagtcgcctgagtacatcagctcccacagtaagttctggtcctcttggtggggctggggacttcctgtccctgagaagccaaatttaagttcctctgtgtcctgtgggagctggaactgcaagcctgtcaccctcccaaccatgtcaccattggcttaggagaagctacc

SEQ ID NO: 733 - DNA, 3240 bp, Homo sapiens
  ENST00000513665
ctaagtcatggttgtcttttcaatacctggtatggtatgaggcacaggatagttgctgacaaacatttgttagctaattatcatgtgctgggggagttggagggagattgaaccaataaagggaaatttgggtacttctgaatgtgccctctgatgagggactgcctgtgtccctcctcagaggctgtcccaagagaagcagacctcagattctgacagcgtgggtgtgggtgacaactgttctacccttggccgccgggagacctgtgatcacggcaaagggaagaagagcagcctggcagaactgaagggctcaatgagcagggctgcgggccgcaagatcacccgtatcattggcttctccaagaagaagacactggccgatgacctgcagacgtcctccaccgaggaggaggttccctgctgtggctacctgaacgtgctggtgaaccagggctggaaggaacgctggtgccgcctgaagtgcaacactctgtatttccacaaggatcacatggacctgcgaacccatgtgaacgccatcgccctgcaaggctgtgaggtggccccgggctttgggccccgacacccatttgccttcaggatcctgcgcaaccggcaggaggtggccatcttggaggcaagctgttcagaggacatgggtcgctggctcgggctgctgctggtggagatgggctccagagtcactccggaggcgctgcactatgactacgtggatgtggagaccttaaccagcatcgtcagtgctgggcgcaactccttcctatatgcaagatcctgccagaatcagtggcctgagccccgagtctatgatgatgttccttatgaaaagatgcaggacgaggagcccgagcgccccacaggggcccaggtgaagcgtcacgcctcctcctgcagtgagaagtcccatcgtgtggacccgcaggtcaaagtcaaacgccacgcctccagtgccaatcaatacaagtatggcaagaaccgagccgaggaggatgcccggaggtacttggtagaaaaagagaagctggagaaagagaaagagacgattcggacagagctgatagcactgagacaggagaagagggaactgaaggaagccattcggagcagcccaggagcaaaattaaaggctctggaagaagccgtggccaccctggaagctcagtgtcgggcaaaggaggagcgccggattgacctggagctgaagctggtggctgtgaaggagcgcttgcagcagtccctggcaggagggccagccctggggctctccgtgagcagcaagcccaagagtggggaaactgcaaataaaccccagaacagcgttccagagcaacctctccctgtcaactgtgtttctgagctgaggaagaggagcccatccatcgtagcctccaaccaaggaagggtgctacagaaagccaaggaatgggaaatgaagaagacctaggaagaggatgaggatttcattccaaaggaaataccagcttgtccacctgaggaagaaatgcttttttcacaaggagacaccaagagaagactaggaagtagccctcgttctccagggcacccaaaataccagcctttattgtctgcatgattttaggggatatggggagggaacaagtagaagggaagagggaaatggagagcatccttatgactttacaaagggtggaaatgaggatggagggatacagaagtctgcacagctgtaaaggttttatagatgtctttgccttcccttctgaggaagggaagaagtaatgaaagcacatgtgaataaccccttccatcccattcacagcatcgcactcccagtccttaaggcaaagggaggcagtgctgaagcattggtggtgcagtgtaaagagacaagacctgatcatctgatcacacttgtgccaacttgattcatattgggcattactaacaacccctggtcaaggtaaataggttgaacaatcaataacattatccctgcctgcatacatgtgaacaaaagctatagaggacatgcaaattctacagtcattcctcatatgctttagacagagtgcagctactggaatcttccagatttcagtgttttaaaatcagagctctgaatacacaaaaggaaagagaaatggagcagctgacatattttaagctcacagtgatactcagtgacaggagcacagagctctaatgtccacaggatgttgtagggtagggtctctcagtaaatcaagtcccttacctatgttctgacactgaggctcttggagctatgggttagaaatccaggaggcaatatgtctttattctaatgaagtcctcatcttgcactcagaggcccactagtttgcccttctatatattaagtaaaaccaagagaaattaagaggatgatggcttctttctgtcacatgggtgctaaaccttttacaaacacttgatacttctatagagggaccaaggacctcaagtcctgggcagtctccttactgtgctactcactactgtctcaacactgtagtgagtctgtctttaacacatttccttccaataaagataaaaccacttaactcttaagtgccagtgcttagctcaagaggaaagaaggaaaatcccagaataaccgtggccactttgctataggggttacatattttaacccacctaaggttttacagactttagcctcactcaaactttatcaccctctgaggtagctggagaccacagcaggaaaaataacctgaccagtaatcacccactgattagtggcagagcgtaggacttaggggttataagcccagatccagatagggctaggtttgagccatgcctctaatgaccagctgggtgaccttgggaaagtcacttgattgctctgattcttgttttccttatctgtgaaatgggactaacaattgttacttttctcccaagattgttgggaagatttaataagataatatatagtaggcatcttgcatagtgtctgagaaataagaaatgctcagtcaatagtggctctcattagccaggcatggtggtactcgcctgtagtcccagctactcaggaggctgaggcaggaggaccgcttgagcccaggagtttgagactgtagtgcactatgatcacgcctgtgaattgccactgcactccagcctaagcaaatagcaagaccccatctattaaaaaaaaaaagtggctattattagctatatcag

SEQ ID NO: 734 - DNA, 3705 bp, Homo sapiens
  ENST00000304129
gagccgcgaggagcgcactccgtggccccgatggagcggtacaaagccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtaggaaaaatattactctgtgtttacagattcattgctgtggtcaggccatttttaagggaagagttatttaatataaatagtctctgattttaagttctgtttaatgttcattctccttccaagaacaaagtggtgatttttggttagggtgatcgccctcttaaaattggcagtgctgttccttgtgctgcccctgtcttttcctctgatggcatttttttttttttttttttaacacaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttagttaggttttttaaaataaaatgttcattgtatttgaa

SEQ ID NO: 735 - DNA, 3964 bp, Homo sapiens
  ENST00000369271
gtgccaaggcggccgggggcggcgagcggggccgcgggcgcgcaccgactcaagagccgactgtcagcctcggcgggccggagttctccggcgctgggacaggggcgctgggacaggggcgctgggggcgagccctggcgggggccaggtccgaggaccctgggcgcggcggccccgccaggaggtccggccgcgagcgtgacctcacggggaggggccagcgcggcggcctgggcgctgagccgagcgccgggagagcagcgcagaagccgagccgcgaggagcgcactccgtggccccgatggagcggtacaaagccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatcccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtaggaaaaatattactctgtgtttacagattcattgctgtggtcaggccatttttaagggaagagttatttaatataaatagtctctgattttaagttctgtttaatgttcattctccttccaagaacaaagtggtgatttttggttagggtgatcgccctcttaaaattggcagtgctgttccttgtgctgcccctgtcttttcctctgatggcatttttttttttttttttttaacacaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttagttaggttttttaaaataaaatgttcattgtatttgaa

SEQ ID NO: 736 - DNA, 3704 bp, Homo sapiens
  ENST00000491814
ctgggtctccagcacaccctggagaaaagcaggtcagggggtggtgcttctgtttccagatgagcaaactagggctgagggagagggcgttctctggtcagggtggtagagccagtctcgtggaagccggctgagccactgaaacagaatcagttttctcatggaccaaacggggatagtgtctggcctgcgccaccccaagtgtattgtgaagatgaaatgagaaggggttttttgttgtggttgctggaaggagatcctagaagggaggaatgggggagaagatggcaaagggatcctaggacgaggcgtatgggcaagggaagcttgtctttctgggaggaaaatctcgaaccaagaatttcaggaagaaggcactgggaaaagagggaggaggtgccctcagatccatggaggtgagtgtcagcccccagatctcttgtgtggccaccactttcacggcaaccactcctcactgggaatccttggagtctggtgctttcaccaccctgccccggctgcttcatgtgtgccacctcgccctgtttccagactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggtaagcagtcactcccagcctcccttggggccagcagaaatgtcactaaggtaggggcccatcttctgacccaggtggtgctttgtggcttttggcaccagctctgagcaagggctcggcactcaccaaggagtggccatggctttgccatgccttcagctcagtctctggcactgaccaaccagaaaggtgtctgcacttggttcgagcatccttccctgtgagcttggggatgcttcagttcttgccctccacacagctatgggtagattccaggaggccagctgcagctcagggacagattatgactgagttttcaaaccaaaaagtcagtcagtgactccacaggacttctaccattaaaactaaagaaacagactcacataggtggtttgaattgcccaaagttgcccacccaactactggcaaaattctcagcaagttgtgaatgaggaatccatgctatgatgcggtttctccctgatggctagtcaaaaaagtatcattaatcatttactcatttactcatttgtacactaaagaacatgcctagggctgcctttgcttttggcaaattctgctccttattcctatcctccttacctgctggagatatttggaggtcccacaacaatggctaaccaataaatccatgcaagcatctgaacctccactcccttgttgctgtgagagacatcacttataggcactcgctgttgtgccacagtctcaaaatctctgaataggcactctaagcagtgatgaacacacagggtttgaaacatttatcacctctgtgcctaaaatagtttttctcacattttttctatgtatatcaaggttgctacagtggataactaactatctttttggtggggggtgggtgctggtatttgaatggtaccctaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtaggaaaaatattactctgtgtttacagattcattgctgtggtcaggccatttttaagggaagagttatttaatataaatagtctctgattttaagttctgtttaatgttcattctccttccaagaacaaagtggtgatttttggttagggtgatcgccctcttaaaattggcagtgctgttccttgtgctgcccctgtcttttcctctgatggcatttttttttttttttttttaacacaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttagttaggttttttaaaataaaatgttcattgtatttg

SEQ ID NO: 737 - DNA, 848 bp, Homo sapiens
  ENST00000486300
tgcgtcccctcctgcagcccggtcccctcctgcatctgcgtcccctcctggagcccagtcccctcttgcatccgcatccgcttcccctcccgcagccccgccccctcctgcatctgtgtgccctcccgaagccccgccccctcctgcatctgcgtcccctcctgcagccctgtcccctcctgcatctgcacttcctcctgcaggttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcc

SEQ ID NO: 738 - DNA, 961 bp, Homo sapiens
  ENST00000419268
gcgaggagcgcactccgtggccccgatggagcggtacaaagcacaggggtgttgctgtctggtggtacagagaaggatccggcaggtttctgcgtccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaa

SEQ ID NO: 739 - DNA, 528 bp, Homo sapiens
  ENST00000483496
gccgagccgcgaggagcgcactccgtggccccgatggagcggtacaaagcctccaggtctctactcacgatgaaagaggcttcggggattctacttcatgaatgaagcccttagcatgtggatttttgcttttctgacccggagccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccc

SEQ ID NO: 740 - DNA, 13746 bp, Homo sapiens
  ENST00000370460
cgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaaggtagctgaatatacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggagatgacccattcctggcctactcctctcacttccatgcatactgctggacactctgagcagagcaccttttccatcccaggacaggaatcgcagcatctgaccccaggattcaccttacaaaagtggaatgacccaaccaccagagcttctacaaagtcagtgtctttcaaatcgatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaagcagattagctgctactacttttaaaagacttaaggtcgggatgcctttttttccatgtaaggaaatgaaaagaccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgtggggagggcagaaagggggtgggggtgggggcgggggggtggggggtggggaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagaaatcctctttgggatcagaagatacctaaaattctccccttttgcccacttggttagatgagtgatatattctttggatcctgcaaagaagagattggtttattttcttttctggtggtggtagtggttgtatctgtggctgtgatggttgttgttacttgtctctctctctctctggctctggcttttgctttcctgctagtgttctttctctttccaaacaaatagttaaattaaatgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacacacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcaactggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 741 - DNA, 7313 bp, Homo sapiens
  ENST00000342251
gccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggaatcgcagcatctgaccccaggattcaccttacaaaagtggaatgacccaaccaccagagcttctacaaagtcagtgtctttcaaatcgatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcc

SEQ ID NO: 742 - DNA, 1488 bp, Homo sapiens
  ENST00000370458
ccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggaatcgcagcatctgaccccaggattcaccttacaaaagtggaatgacccaaccaccagagcttctacaaagatgcttgaggatgacctgaagctgagcagtgatgaagatgaccttgagcctgtgaagaccttgaccactcagtgcactgccactgagctctaccaggctgttgaaaaggcaaaacctaggaataatcctgtgaagtaagttattatttttattagttgcaaatgttaattttaacggactcgatgcatgtgaaaaaataaggtcataaaagagaccttggattttgagttaatctctattcatgacaatttaa

SEQ ID NO: 743 - DNA, 3952 bp, Homo sapiens
  ENST00000370457
acccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaaggtagctgaatatacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggaatcgcagcatctgaccccaggattcaccttacaaaagtggaatgacccaaccaccagagcttctacaaagatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggt

SEQ ID NO: 744 - DNA, 12280 bp, Homo sapiens
  ENST00000286437
agttttggttgtggcaacccagaggaaggttgcagtggcccatctatctatcccagatgtaagatatgcttcacccctctttcttgatccatgaagttcaaaaggaggcaccaagcatttccgtccttcttcaagatgaaggtaagccttcccagtgatccaagctgtgttgaagaaatcttgcgggaatcgcagcatctgaccccaggattcaccttacaaaagtggaatgacccaaccaccagagcttctacaaagtcagtgtctttcaaatcgatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaagcagattagctgctactacttttaaaagacttaaggtcgggatgcctttttttccatgtaaggaaatgaaaagaccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgtggggagggcagaaagggggtgggggtgggggcgggggggtggggggtggggaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagaaatcctctttgggatcagaagatacctaaaattctccccttttgcccacttggttagatgagtgatatattctttggatcctgcaaagaagagattggtttattttcttttctggtggtggtagtggttgtatctgtggctgtgatggttgttgttacttgtctctctctctctctggctctggcttttgctttcctgctagtgttctttctctttccaaacaaatagttaaattaaatgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacacacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcaactggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 745 - DNA, 197 bp, Homo sapiens
  ENST00000513720
tttcttaagaattaagggacagactatgggctggaggactttgaggatgtctgtctcataacacttgggttgtatctgttctatggggcttgttttaagcttggcaacttgcaacagggttcactgactttctccccaggcccaagcttccatattggattcttaccaatgtactgcagagataagtttagctgacc

SEQ ID NO: 746 - DNA, 317 bp, Homo sapiens
  ENST00000515675
gactatgggctggaggactttgaggatgtctgtctcataacacttgggttgtatctgttctatggggcttgttttaagcttggcaacttgcaacagggttcactgactttctccccaggcccaaggtattccttcataacaaatactttggctttcatatatttgagtaaagtcccccttgaggaagagtagaagaactgcactttgtaaatactatcctggaatccaaacggatagacaaggatggtgctacctctttctggagacttccatattggattcttaccaatgtactgcagagataagtttagctgacc

SEQ ID NO: 747 - DNA, 2484 bp, Homo sapiens
  ENST00000395792
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaactttccaagccataactgttactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacaatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgtttccttttccaagtttgcttatttatgaaaagttatcgataatttctttagttttgtataccattgtctgaagcagattctgttaaaatagcattaagtgttggttattataggagattaaagctatccaaggatggatttacagcactagatcacttggtgaactgaaaaatgttcccaagttaaacactatttgatgctaccagggcattttgtttattaaatgaccatcactgaagtattctaacagataatctggagatgagaaaagaaattattattcttctatgggatctaagaaaatttaacatctactttttttctcaatcttgttcagttctctattcacagacattttaaaacataagaatattacagttttgattgaatataattaa

SEQ ID NO: 748 - DNA, 1914 bp, Homo sapiens
  ENST00000226359
aaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaactttccaagccataactgttactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacaatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagaggggaagagaagacaaaacgagtctttcattcggtgtgaacttttctctttaattttaactgatttaacactttttgtgaattaatgaaatgataaagacttttatgtgagatt

SEQ ID NO: 749 - DNA, 728 bp, Homo sapiens
  ENST00000508838
agaagcaaggcggctaaaaactcatgaatgactcagcaggacttagttaaaaaatgcttctttcaggtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacaatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgaga

SEQ ID NO: 750 - DNA, 693 bp, Homo sapiens
  ENST00000514279
ggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacaatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggtaacaaaacattcagacaagcctgaatacaatgttgtttctccagaaatatcaatccataatgagatagatcatgaggagtgccattaattctcttaaaaatacatggaattcaaaaaaaagtttattttaaaaacacttgaacaaaattacgcacacaatgttaaattagtggctcaactatgcaaaatcctttttggttatttaaaagacttcaacaaatgctatcagaagactttcctacgtatccaatatttctctgatataaaataatagaacc

SEQ ID NO: 751 - DNA, 476 bp, Homo sapiens
  ENST00000506820
atgaggggagattgccttccactacacataagtatggtcaagtatgaaatagtgttttatccacaacctgcacaactccaggctggtggaacacttggcatgctttcagcctcaatctttctactgaaagtactagacaaggtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgtt

SEQ ID NO: 752 - DNA, 2165 bp, Homo sapiens
  ENST00000409457
ggcgctcggagcgggctccgcggcttgcaaggcgcctgcgactcggtcccaggtcggcgggcggcgcacggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcctgcccttctttgtccttgcactgacagccagcacttatctcaggcctgctggagcccgtgcccgtcagtcctccccctggccagggccgaggggtggtcagaccagcccgcattgtgctgaaggcccacaatcagcccagctgtccggggccatgatgaattagcggtgggagttaacatagaggtgaactccagatcggccgatagcttgcaggccgctgctgtttgtcctgacttcagcgcatctctgatagacctttgacaccttccaacaaagaggttacaggagggagagctggagaaatggagcgctcctccagaaagttcggcaactcacaaaagaccccttaatttctatagcgggcaattcagtccacaaaggaaggaaatcaatgagcgtttacgctctttctttgaggaacctttttttaaagaaaaaaacatttactggcgctttgcatgttttgggtacaagcagtggtagaaacataaaacattaaaatccaagattga

SEQ ID NO: 753 - DNA, 5427 bp, Homo sapiens
  ENST00000336665
cgcggcttgcaaggcgcctgcgactcggtcccaggtcggcgggcggcgcacggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaa

SEQ ID NO: 754 - DNA, 10832 bp, Homo sapiens
  ENST00000304032
cgcggcttgcaaggcgcctgcgactcggtcccaggtcggcgggcggcgcacggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtgacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaatgacttcttgtttcactttgccttccacaacctgaatgccagattggttttttcccttcctggcccccagcacaagctgccatgactccccctcagaaaacacagcccctcctctaccattctcagtgatgtccatctgctccactccgcagccactttctagggcccaagttttggtagcagaaggaaaggcagtttttgagggtctttcgaaaaaaagaagacggggcagctttgcccagagctcgttggcagtctgtttgtatttcagtgtctaaccagaagtcctttctttgcggaccgcactctcgttcccactttcaagctaattaccaccaaggctgggagaggcaaggactgggggcggagctaggaataactcgtttgagaagggggtggagttttcgttgttcatttccatgttcagttctgtgacgtgacgatgacagatcaccactgcaggatccccctcacctttcctgttcagaattaaaactctcccttgatgagaaacagccagctgagggaggcccacgagcggcctgtgtaaccccatgggtgatctggacacatctgcacccccgcgttcagcttcgcggagactgaacttggcggggagtggaggggtgtggtgcagacctggctgcagcagaaacaccccgcagggacagtactctgtgattctgacctcaggtgctgggacgggcagatggtttcccccgcccagcaccccagtcctggtccctggtccctctctctgtttcatcccaggaaatgagcagctcgagggtgagcaagtgacaagttcctgagtcactggccccaaaaccaggtgcagtgtcctgtctcccaagtgtgtgcacaatgtatatatgcactggaaaggagggagaaggcagcgggtcactcgccaatcgcagggttctcagacacaggagagagcgggatcttaatgaattgcatttcctgcagagcctctagtgcacaggccagttctcggcagtggcttttcagcacaagggccttgcattgaagctccctcttctgagatttcacccagcctgatgaggcctgcatggttccggcctcgtcatccagtgtagataccagtcttcctatttttgtgacatctgcacatttggggtcattccctatatctgcataggagctattgctaaccttgttagggagaaacatggtctaatgagaaagacagacccctaggctcagctggccctgccatccttccagaggattcctctgcaactctaggcaagcacccagcttcctgggctctttttcctcatctgtgaaacttgcagggtgcagtgaggtttcaaaccagtgtgataagtgttggcctcacacctggcccaggggatgctgggagaacaggagcacttgttaataacagaaacactgatgggaccgaagccagtgcacacaccaggaaacctgcccgtggctgacactgtcctccagcctgcattctggggaggctgtgatgggcacgtttgccaaccccccccccccagtagagcccaggaccctcctctctcagcttgccagtgccctgccctccacatggcggggaacagcatcaatgaggtccttgctccctgagagcctctctggaacctgcccacttttctcaacatgtatattctgctttgtagtctgaggttgattttctagaggcgaggaaggggctgagttctgccctcgtgctgttcgctggtgctgatcagggccaagacgacccttccctctcccccacagcctgttgaggtgccgttgacgtggacagcgcccctcccttaagatgcccccttgccgttgccatgagccgctgtgactcacgcgtgcactgggccttgcttggtgctcccctcctcctcctgtctgagatcggagcttgctggagagcaccccaggtcgccgtgcttggctgcaggcccgtccctctctccccatcctcgggttcccagcgtgttttgtgcttgaacttggtggactcatcttaccccacaagagtggcctgctcaacctgcagcctccaatgtgccgtaggcgctctaggtccccgtggcgcccaggacaccaactctccctccctgcacttaggatgttctggaaatgagaggaaatccacattcctgccccaggaggtgggaagcctggcaacgatgtagcttcccctgagatgcggtatgatcaggcctcagcaactactcaggaggcaaaggtgtttggaaagcaaaccccaaacctcccggcacggcatgtgctctgcttccgtccctcaccgcctgcacaaggtcgttgagacttttctagaactccccggggttgtatttatggccttcaagcaaacaaattgaaaagcagtcaaggaggagttcagatagaaaagtgctggagatacacatctttccttcaaaggaaatgtaatttatttccaaccgctgcctcagacgggggtttcacatgttgtgaagtcacatcttgaatgactgtcaccctcatccttccccaaaaagctaaataagggcctttggcatcaatgcgtgcattctccacctttccgcggcttgcgcttggatttctgagtggctttcttcagggagcccttgtggtcatgtgtctttaatgctgctccccatgcccccaggccaggccagcacgctcaggtgatagcgagtggggccaggagacccccctgccctgcccagtggacagatctgccccagccctgctgtggggacgggccctctatcatttaaccacatacattaggttgcttttcagcaaaatgtcagctttcctcccattatgcaggagagagaaggggcgcaggtgtatctccttagagtacaccttggagctggatcactaagaaacagtcctcagactggtccttccgacacaggcagagagtgaactggatcgctggcccctgggatgctgcgctgtctgtgattagagagaagtggccagtgtcccgtctgtgattagacagaaacccctgtggcagactcctcccctctccatgaagaaagaaatatttacttagatattactgtttcaaaacacaaactttattccccttagagaagaaatactgcccttaaatagactgttgaaatattaatggcccccccatttaatcagtgtgtctgcggctttcttcgcgtcacatgtccgcattggcaggtgattctggaaagggattctgggaaaccaacaagtcttttttaaatctttgagttgtatgagaaagtatttaagttcaccagtgtagtaaacacccaccccagagcagcggtaagcaaacctaaatctgaaaacccattcttactgtctttcaccatgagatgctggttttggtgtaaaatgacagcacttggtttggggttttgcacctgttgggtagaactgttcttgtctgaggtcctcaccctctacagatgggcctcagggcctggaggtgggcagatggggccagagtggccagcagagacttgcatgggctctgaaagccccagagctcaggcctaaggctgctaggtgagaccagcaggcagctgtggcatccgaccttgggacgcccaagctgggcagccgctccatgtgccccaaacaggatatcctcatgaatgtgaggagaggctggctcagggcttggttttcattttggcctggcacagggtacctgtagggagcactcccccaacctgaggatggtgaaaccatatgatagagactccttgtcgaagtccacatcggactgatctagaatgccccgtggggggattgcatggcctttgccttgagatgcaggtgaaagaaaggaaccaaacaaggcatgagtgtgttggggaatcttcccagtggagcaaacccccttaacacaccagctgttgggaacagctgcccctaaatccaattaaaccctcatctccctggtgctgaacagtctacactggcccaggaagctaacgtctgagccgcttggagagctttggtaaacagaagacactggaagcccactcggtcagcagctgggcatgaggatgtcaggggcctttggacttgaggaaggacagtccaggtgcatggaatcctaatgggcctcatgcagacactggaagcagcccagccccctgcccaataccacagccctggggtgtcccctgacattcctggaggtccctgggcaaatgcatttcctgcctgggttctcagggtaggagaacagagaaggctccaagggtgttgggagtgagccaggggctggtctggggagtgggtctcacgcactgctcaggttggcacgagggacctcccccatcccaacccagccccaagggtcccagcagggctctcagcatggctgttttgagggtacacaggtggctggagaggggtggggcagttgcatggtgggtggcaaagtgtgcatttagaagctgcttcgtggcgttaagaacggggggagagggaccagcactgtaacgttagaaataattccttcttgcagacttgaaaagcatcagtttccctcccacggctgggtttttgtgtctgaaatacatctaattctccagactgcagcccctctcagccccgagcacctgagcgctggggaggcccttattgagctcagcctggagaggggagggtcgcacgggtcccgggggcaggtctcctgcactggctcttcccttctgccagcttggaatttggttctcatcttgccacaggggtgcgtttcctaaagggcagccggagcagctcaaaggtgacaactgagatgcatttctaggcaggggcagggaaggccaacccaccttgcagccagttttctgtttctgtaaatagcagtgtatagagatggaagggcagcgtgggtgtatccacagatgggtttaggttttttttttggatgttttctattacctcattcagcaactttatgtttcacaatgactcaatgatgctttatttatattgtttgtactgtaattaaaaccattgacagacatttcactttgcttgttatttcatatgatcttgttttgattaaatatgccagtttgtattttcctgccttgggatttttttgtgtccgctgtacagtattctaagggaaaaagaaaaagaaagatgtgtaaagtaacagagagaggtggctatggtgtagagacctctttctaataaagaaatgaaaatatgtctacaccgct

SEQ ID NO: 755 - DNA, 2478 bp, Homo sapiens
  ENST00000635100
cagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggaatatggatgcaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcac

SEQ ID NO: 756 - DNA, 563 bp, Homo sapiens
  ENST00000402604
atccggtttggcaggaacaggacagggtggttagcaggccacagtgtggtgggagtgaaagtgtactgtcctgtgtgatatttttgcacagcctgacagtgggggcaagtttagagcctttgagctgagaatctggagagagcagtggatgcgatgggcagttgcttgtccttgctgtgagaagacaggccacggggctgcacccagcccccatggatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgag

SEQ ID NO: 757 - DNA, 6138 bp, Homo sapiens
  ENST00000409538
gcgcgtttccattttaaaccgccgcccgccgcccgccacccgccacccttcggccgcagccggtgcagctgtccgcgcgtcccggagcccagggagtggcggaggctgcggaaccgccgagctgtgcagccggagcgggaggatgcgcacgggccccgcgtcgtagacaatgaagccgcgggcgccgccgcctgccctgggccctgcgcaccgcggccgcacctgccggcgagagcgctctagcgcctgaccggccgcctcgcttggccccgccggcccatggctcggcgccccgggcccggaccccggcactcgggcggcgcggcgcacgggccggcgggtgccaggggcgccgtccccgcagcctgagtgcggccctcgcggtcagcggggggcgtgggccacactcccggcccgcctgccctccccgcttggcccggcgccctcccggcccgcgggctcgctggatgcggcggggccccagcgcgcgggcgacatgtacttgttggacggcagtggcgagcccgcgtcgccacccgcggacgcgatgccgcgcgggacgccccccagaaagactgtctaccgcatctccgtgaccatggtcaggaaggagcagctggccgcgccgggctccggcggcccggacccacgcccggttcggcggccccggcccgcgcgctccccggacgcgcccgggaggcttgaggaggaggccgaggaggcggagggcgccgaggaaccggagggtccccggccgcgcgcttgggatttccgcaccttccgcacccgcagcaccgggcagctggaactggggcggctccggccgtgcgcacgcggcctggaacccgcggacctggccggcagcgccccggccgaggaggagggacgcggctcgcccgcgtccggcagccccgacgtggagggggcccgggccgcgcccctgcggcggagcctgagcttcaggcactggagcgggcctgaggcgccgcaaggccggacactgggcggcggaaggcgccacagcagctccgggagcctggcctgggcgccgtgcgacgaggccgcggccgggaccaccctggagcccgcgaccgccacgcagcccgcctcggagaagcgcaacaccctggacgtgggcgaggtgctcagcaagaacgacgcgctctcggacctggagcgttgggaacgcagtaagagcaagaaccgcacgctggacaacagcgacctgcagcggctggagcgcgcgcgggcggcggccggggccggcgcggcctcggagcaccggctgctgcgcttcttcagcggcatcttcgcgcgcagggacgggggcccgggcggcgggccctcgccacggagcggagcctcgcggccacgcggctacttcagcctgcggcgggccccggccgaagcgcactcgtccagcgccgagagcatcgacggctccccgcgcagagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaa

SEQ ID NO: 758 - DNA, 757 bp, Homo sapiens
  ENST00000448025
gaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtgacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagccaaacgcaaagcatggaaactaaaccgtgttggtagcctgcgaaatatatacagcagcagcaccaacactgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgc

SEQ ID NO: 759 - DNA, 826 bp, Homo sapiens
  ENST00000418654
ctccagccctaaaaccaatggcctatccaaggacatgagcagtttacacatctcacccaattcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagccaaacgcaaagcatggaaactaaaccgtgttggtagcctgcgaaatatatacagcagcagcaccaacactgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggcc

SEQ ID NO: 760 - DNA, 541 bp, Homo sapiens
  ENST00000466575
aaaacaagagtgattgtttagaaattaccctcgtcctacatttgctcccaatctgtttgatctttccctgatgttatcagtgatgtgcgtttctcccggggtgcttacgccttgtatttgtgtcttcctccgtgcccagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccag

SEQ ID NO: 761 - DNA, 864 bp, Homo sapiens
  ENST00000482882
tcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaaggtaggaactttggaagatgcctggctcccgacacgtttgccaacagttaggcaactggaagtgatcataatgacagccacggttgggaaggccctgataacctgtaggaattcgggaattccgattcatccggcataggaatgtctgtgtttaaagttggtcttgagcagacgtggataattcacactccttaattttttatgtttgtttttaggcctggggatttctctcccccctcttagaaatgtattaagcttctaaccttatgaatatattactttaattaatacatttctaataggcataagctgtgccgttaacactaattatgaatttttgatcctttaattttgttattcttatagcttggataagcatctgctctgtcgatcccccccccgcaccatcacacaaaagttatttttatggtaacaaaatctattttattttctaaaatatatctcaacacatttagtcaaccaagttcagcataatgtatgatgtaactcctcattaatgttaattgttatccagtgtaaaaaacgcattt

SEQ ID NO: 762 - DNA, 2138 bp, Homo sapiens
  ENST00000453371
ttcagagaattcggagtccggcacaggaatgtgtcccacgcatgaatgtcgtccttcagatctggacctgacagcctgggagctgctggggggagatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaa

SEQ ID NO: 763 - DNA, 1057 bp, Homo sapiens
  ENST00000619456
agatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcctgcccttctttgtccttgcactgacagccagcacttatctcaggcctgctggagcccgtgcccgtcagtcctccccctggccagggccgaggggtggtcagaccagcccgcattgtgctgaaggcccacaatcagcccagctgtccggggccatgatgaattag

SEQ ID NO: 764 - DNA, 10090 bp, Homo sapiens
  ENST00000428334
gatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtgacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaatgacttcttgtttcactttgccttccacaacctgaatgccagattggttttttcccttcctggcccccagcacaagctgccatgactccccctcagaaaacacagcccctcctctaccattctcagtgatgtccatctgctccactccgcagccactttctagggcccaagttttggtagcagaaggaaaggcagtttttgagggtctttcgaaaaaaagaagacggggcagctttgcccagagctcgttggcagtctgtttgtatttcagtgtctaaccagaagtcctttctttgcggaccgcactctcgttcccactttcaagctaattaccaccaaggctgggagaggcaaggactgggggcggagctaggaataactcgtttgagaagggggtggagttttcgttgttcatttccatgttcagttctgtgacgtgacgatgacagatcaccactgcaggatccccctcacctttcctgttcagaattaaaactctcccttgatgagaaacagccagctgagggaggcccacgagcggcctgtgtaaccccatgggtgatctggacacatctgcacccccgcgttcagcttcgcggagactgaacttggcggggagtggaggggtgtggtgcagacctggctgcagcagaaacaccccgcagggacagtactctgtgattctgacctcaggtgctgggacgggcagatggtttcccccgcccagcaccccagtcctggtccctggtccctctctctgtttcatcccaggaaatgagcagctcgagggtgagcaagtgacaagttcctgagtcactggccccaaaaccaggtgcagtgtcctgtctcccaagtgtgtgcacaatgtatatatgcactggaaaggagggagaaggcagcgggtcactcgccaatcgcagggttctcagacacaggagagagcgggatcttaatgaattgcatttcctgcagagcctctagtgcacaggccagttctcggcagtggcttttcagcacaagggccttgcattgaagctccctcttctgagatttcacccagcctgatgaggcctgcatggttccggcctcgtcatccagtgtagataccagtcttcctatttttgtgacatctgcacatttggggtcattccctatatctgcataggagctattgctaaccttgttagggagaaacatggtctaatgagaaagacagacccctaggctcagctggccctgccatccttccagaggattcctctgcaactctaggcaagcacccagcttcctgggctctttttcctcatctgtgaaacttgcagggtgcagtgaggtttcaaaccagtgtgataagtgttggcctcacacctggcccaggggatgctgggagaacaggagcacttgttaataacagaaacactgatgggaccgaagccagtgcacacaccaggaaacctgcccgtggctgacactgtcctccagcctgcattctggggaggctgtgatgggcacgtttgccaaccccccccccccagtagagcccaggaccctcctctctcagcttgccagtgccctgccctccacatggcggggaacagcatcaatgaggtccttgctccctgagagcctctctggaacctgcccacttttctcaacatgtatattctgctttgtagtctgaggttgattttctagaggcgaggaaggggctgagttctgccctcgtgctgttcgctggtgctgatcagggccaagacgacccttccctctcccccacagcctgttgaggtgccgttgacgtggacagcgcccctcccttaagatgcccccttgccgttgccatgagccgctgtgactcacgcgtgcactgggccttgcttggtgctcccctcctcctcctgtctgagatcggagcttgctggagagcaccccaggtcgccgtgcttggctgcaggcccgtccctctctccccatcctcgggttcccagcgtgttttgtgcttgaacttggtggactcatcttaccccacaagagtggcctgctcaacctgcagcctccaatgtgccgtaggcgctctaggtccccgtggcgcccaggacaccaactctccctccctgcacttaggatgttctggaaatgagaggaaatccacattcctgccccaggaggtgggaagcctggcaacgatgtagcttcccctgagatgcggtatgatcaggcctcagcaactactcaggaggcaaaggtgtttggaaagcaaaccccaaacctcccggcacggcatgtgctctgcttccgtccctcaccgcctgcacaaggtcgttgagacttttctagaactccccggggttgtatttatggccttcaagcaaacaaattgaaaagcagtcaaggaggagttcagatagaaaagtgctggagatacacatctttccttcaaaggaaatgtaatttatttccaaccgctgcctcagacgggggtttcacatgttgtgaagtcacatcttgaatgactgtcaccctcatccttccccaaaaagctaaataagggcctttggcatcaatgcgtgcattctccacctttccgcggcttgcgcttggatttctgagtggctttcttcagggagcccttgtggtcatgtgtctttaatgctgctccccatgcccccaggccaggccagcacgctcaggtgatagcgagtggggccaggagacccccctgccctgcccagtggacagatctgccccagccctgctgtggggacgggccctctatcatttaaccacatacattaggttgcttttcagcaaaatgtcagctttcctcccattatgcaggagagagaaggggcgcaggtgtatctccttagagtacaccttggagctggatcactaagaaacagtcctcagactggtccttccgacacaggcagagagtgaactggatcgctggcccctgggatgctgcgctgtctgtgattagagagaagtggccagtgtcccgtctgtgattagacagaaacccctgtggcagactcctcccctctccatgaagaaagaaatatttacttagatattactgtttcaaaacacaaactttattccccttagagaagaaatactgcccttaaatagactgttgaaatattaatggcccccccatttaatcagtgtgtctgcggctttcttcgcgtcacatgtccgcattggcaggtgattctggaaagggattctgggaaaccaacaagtcttttttaaatctttgagttgtatgagaaagtatttaagttcaccagtgtagtaaacacccaccccagagcagcggtaagcaaacctaaatctgaaaacccattcttactgtctttcaccatgagatgctggttttggtgtaaaatgacagcacttggtttggggttttgcacctgttgggtagaactgttcttgtctgaggtcctcaccctctacagatgggcctcagggcctggaggtgggcagatggggccagagtggccagcagagacttgcatgggctctgaaagccccagagctcaggcctaaggctgctaggtgagaccagcaggcagctgtggcatccgaccttgggacgcccaagctgggcagccgctccatgtgccccaaacaggatatcctcatgaatgtgaggagaggctggctcagggcttggttttcattttggcctggcacagggtacctgtagggagcactcccccaacctgaggatggtgaaaccatatgatagagactccttgtcgaagtccacatcggactgatctagaatgccccgtggggggattgcatggcctttgccttgagatgcaggtgaaagaaaggaaccaaacaaggcatgagtgtgttggggaatcttcccagtggagcaaacccccttaacacaccagctgttgggaacagctgcccctaaatccaattaaaccctcatctccctggtgctgaacagtctacactggcccaggaagctaacgtctgagccgcttggagagctttggtaaacagaagacactggaagcccactcggtcagcagctgggcatgaggatgtcaggggcctttggacttgaggaaggacagtccaggtgcatggaatcctaatgggcctcatgcagacactggaagcagcccagccccctgcccaataccacagccctggggtgtcccctgacattcctggaggtccctgggcaaatgcatttcctgcctgggttctcagggtaggagaacagagaaggctccaagggtgttgggagtgagccaggggctggtctggggagtgggtctcacgcactgctcaggttggcacgagggacctcccccatcccaacccagccccaagggtcccagcagggctctcagcatggctgttttgagggtacacaggtggctggagaggggtggggcagttgcatggtgggtggcaaagtgtgcatttagaagctgcttcgtggcgttaagaacggggggagagggaccagcactgtaacgttagaaataattccttcttgcagacttgaaaagcatcagtttccctcccacggctgggtttttgtgtctgaaatacatctaattctccagactgcagcccctctcagccccgagcacctgagcgctggggaggcccttattgagctcagcctggagaggggagggtcgcacgggtcccgggggcaggtctcctgcactggctcttcccttctgccagcttggaatttggttctcatcttgccacaggggtgcgtttcctaaagggcagccggagcagctcaaaggtgacaactgagatgcatttctaggcaggggcagggaaggccaacccaccttgcagccagttttctgtttctgtaaatagcagtgtatagagatggaagggcagcgtgggtgtatccacagatgggtttaggttttttttttggatgttttctattacctcattcagcaactttatgtttcacaatgactcaatgatgctttatttatattgtttgtactgtaattaaaaccattgacagacatttcactttgcttgttatttcatatgatcttgttttgattaaatatgccagtttgtattttcctgccttgggatttttttgtgtccgctgtacagtattctaagggaaaaagaaaaagaaagatgtgtaaagtaacagagagaggtggctatggtgtagagacctctttctaataaagaaatgaaaatatgtctacaccgct

SEQ ID NO: 765 - DNA, 9932 bp, Homo sapiens
  ENST00000614409
agatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaatgacttcttgtttcactttgccttccacaacctgaatgccagattggttttttcccttcctggcccccagcacaagctgccatgactccccctcagaaaacacagcccctcctctaccattctcagtgatgtccatctgctccactccgcagccactttctagggcccaagttttggtagcagaaggaaaggcagtttttgagggtctttcgaaaaaaagaagacggggcagctttgcccagagctcgttggcagtctgtttgtatttcagtgtctaaccagaagtcctttctttgcggaccgcactctcgttcccactttcaagctaattaccaccaaggctgggagaggcaaggactgggggcggagctaggaataactcgtttgagaagggggtggagttttcgttgttcatttccatgttcagttctgtgacgtgacgatgacagatcaccactgcaggatccccctcacctttcctgttcagaattaaaactctcccttgatgagaaacagccagctgagggaggcccacgagcggcctgtgtaaccccatgggtgatctggacacatctgcacccccgcgttcagcttcgcggagactgaacttggcggggagtggaggggtgtggtgcagacctggctgcagcagaaacaccccgcagggacagtactctgtgattctgacctcaggtgctgggacgggcagatggtttcccccgcccagcaccccagtcctggtccctggtccctctctctgtttcatcccaggaaatgagcagctcgagggtgagcaagtgacaagttcctgagtcactggccccaaaaccaggtgcagtgtcctgtctcccaagtgtgtgcacaatgtatatatgcactggaaaggagggagaaggcagcgggtcactcgccaatcgcagggttctcagacacaggagagagcgggatcttaatgaattgcatttcctgcagagcctctagtgcacaggccagttctcggcagtggcttttcagcacaagggccttgcattgaagctccctcttctgagatttcacccagcctgatgaggcctgcatggttccggcctcgtcatccagtgtagataccagtcttcctatttttgtgacatctgcacatttggggtcattccctatatctgcataggagctattgctaaccttgttagggagaaacatggtctaatgagaaagacagacccctaggctcagctggccctgccatccttccagaggattcctctgcaactctaggcaagcacccagcttcctgggctctttttcctcatctgtgaaacttgcagggtgcagtgaggtttcaaaccagtgtgataagtgttggcctcacacctggcccaggggatgctgggagaacaggagcacttgttaataacagaaacactgatgggaccgaagccagtgcacacaccaggaaacctgcccgtggctgacactgtcctccagcctgcattctggggaggctgtgatgggcacgtttgccaaccccccccccccagtagagcccaggaccctcctctctcagcttgccagtgccctgccctccacatggcggggaacagcatcaatgaggtccttgctccctgagagcctctctggaacctgcccacttttctcaacatgtatattctgctttgtagtctgaggttgattttctagaggcgaggaaggggctgagttctgccctcgtgctgttcgctggtgctgatcagggccaagacgacccttccctctcccccacagcctgttgaggtgccgttgacgtggacagcgcccctcccttaagatgcccccttgccgttgccatgagccgctgtgactcacgcgtgcactgggccttgcttggtgctcccctcctcctcctgtctgagatcggagcttgctggagagcaccccaggtcgccgtgcttggctgcaggcccgtccctctctccccatcctcgggttcccagcgtgttttgtgcttgaacttggtggactcatcttaccccacaagagtggcctgctcaacctgcagcctccaatgtgccgtaggcgctctaggtccccgtggcgcccaggacaccaactctccctccctgcacttaggatgttctggaaatgagaggaaatccacattcctgccccaggaggtgggaagcctggcaacgatgtagcttcccctgagatgcggtatgatcaggcctcagcaactactcaggaggcaaaggtgtttggaaagcaaaccccaaacctcccggcacggcatgtgctctgcttccgtccctcaccgcctgcacaaggtcgttgagacttttctagaactccccggggttgtatttatggccttcaagcaaacaaattgaaaagcagtcaaggaggagttcagatagaaaagtgctggagatacacatctttccttcaaaggaaatgtaatttatttccaaccgctgcctcagacgggggtttcacatgttgtgaagtcacatcttgaatgactgtcaccctcatccttccccaaaaagctaaataagggcctttggcatcaatgcgtgcattctccacctttccgcggcttgcgcttggatttctgagtggctttcttcagggagcccttgtggtcatgtgtctttaatgctgctccccatgcccccaggccaggccagcacgctcaggtgatagcgagtggggccaggagacccccctgccctgcccagtggacagatctgccccagccctgctgtggggacgggccctctatcatttaaccacatacattaggttgcttttcagcaaaatgtcagctttcctcccattatgcaggagagagaaggggcgcaggtgtatctccttagagtacaccttggagctggatcactaagaaacagtcctcagactggtccttccgacacaggcagagagtgaactggatcgctggcccctgggatgctgcgctgtctgtgattagagagaagtggccagtgtcccgtctgtgattagacagaaacccctgtggcagactcctcccctctccatgaagaaagaaatatttacttagatattactgtttcaaaacacaaactttattccccttagagaagaaatactgcccttaaatagactgttgaaatattaatggcccccccatttaatcagtgtgtctgcggctttcttcgcgtcacatgtccgcattggcaggtgattctggaaagggattctgggaaaccaacaagtcttttttaaatctttgagttgtatgagaaagtatttaagttcaccagtgtagtaaacacccaccccagagcagcggtaagcaaacctaaatctgaaaacccattcttactgtctttcaccatgagatgctggttttggtgtaaaatgacagcacttggtttggggttttgcacctgttgggtagaactgttcttgtctgaggtcctcaccctctacagatgggcctcagggcctggaggtgggcagatggggccagagtggccagcagagacttgcatgggctctgaaagccccagagctcaggcctaaggctgctaggtgagaccagcaggcagctgtggcatccgaccttgggacgcccaagctgggcagccgctccatgtgccccaaacaggatatcctcatgaatgtgaggagaggctggctcagggcttggttttcattttggcctggcacagggtacctgtagggagcactcccccaacctgaggatggtgaaaccatatgatagagactccttgtcgaagtccacatcggactgatctagaatgccccgtggggggattgcatggcctttgccttgagatgcaggtgaaagaaaggaaccaaacaaggcatgagtgtgttggggaatcttcccagtggagcaaacccccttaacacaccagctgttgggaacagctgcccctaaatccaattaaaccctcatctccctggtgctgaacagtctacactggcccaggaagctaacgtctgagccgcttggagagctttggtaaacagaagacactggaagcccactcggtcagcagctgggcatgaggatgtcaggggcctttggacttgaggaaggacagtccaggtgcatggaatcctaatgggcctcatgcagacactggaagcagcccagccccctgcccaataccacagccctggggtgtcccctgacattcctggaggtccctgggcaaatgcatttcctgcctgggttctcagggtaggagaacagagaaggctccaagggtgttgggagtgagccaggggctggtctggggagtgggtctcacgcactgctcaggttggcacgagggacctcccccatcccaacccagccccaagggtcccagcagggctctcagcatggctgttttgagggtacacaggtggctggagaggggtggggcagttgcatggtgggtggcaaagtgtgcatttagaagctgcttcgtggcgttaagaacggggggagagggaccagcactgtaacgttagaaataattccttcttgcagacttgaaaagcatcagtttccctcccacggctgggtttttgtgtctgaaatacatctaattctccagactgcagcccctctcagccccgagcacctgagcgctggggaggcccttattgagctcagcctggagaggggagggtcgcacgggtcccgggggcaggtctcctgcactggctcttcccttctgccagcttggaatttggttctcatcttgccacaggggtgcgtttcctaaagggcagccggagcagctcaaaggtgacaactgagatgcatttctaggcaggggcagggaaggccaacccaccttgcagccagttttctgtttctgtaaatagcagtgtatagagatggaagggcagcgtgggtgtatccacagatgggtttaggttttttttttggatgttttctattacctcattcagcaactttatgtttcacaatgactcaatgatgctttatttatattgtttgtactgtaattaaaaccattgacagacatttcactttgcttgttatttcatatgatcttgttttgattaaatatgccagtttgtattttcctgccttgggatttttttgtgtccgctgtacagtattctaagggaaaaagaaaaagaaagatgtgtaaagtaacagagagaggtggctatggtgtagagacctctttctaataaagaaatgaaaatatgtctacaccgct

SEQ ID NO: 766 - DNA, 1798 bp, Homo sapiens
  ENST00000528609
ctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaatgaagttcactcagtgtctagcagagcttaaggagcttttacgacaggaaatccacaagaaattccatgaacttggacaagatgtagatttagaaggaagttggagtgacatctctttgtctgacattgaatccagcaccagtggctctgacagttctctctcagatggtcttcctgttcacctagcaaacatagcagatgagctgactcagaaaaagaagatgtttaagaagaaaaaaaagaagtcacttcagactaggaaacagcgaaatgagcagtatcagaaaaaaaatttgatgcagaagttaaagttaacagaagatacctcagaaaaggcaggatttgcttctactctgcaaaagcagccaacctttttcaaaaactcagagaattccagttttttaccaatgaaaaatgaaaacccaaggttaaatgagacaaatttaaatagaagagacaaagacacccccctggacccatcaatggccaccctgattctgcctaagaataaagggagaatgcagaataagaagccaggctttacagtatcatgctctccaaagagaaccataaactccagccaagagccagctccaggtatgaagccaaactggcctaggagcagatatcctgccacaaagagaggctgtgctgccatggcggcatacccatccttgcacatatacacatacccgtaggtgagcctgggctgtgccacacaagcacttcatcgggggttttgagattagacacattttataatgggggagatgtatgactgggaactgcatttacttgtggtatactgtgttgtgcactcatgcactgaccttacactttgtacttacactgtgggcatgtggtcaagatgcatacctcatgaattcaactattttttcataaaatgaaattttattatgatgtgtaaaaatgctttatcagaaactgaagtgtgttctcatggcacacttcatggcagcacagatatacctcattttaaccaatagatattctctctaaaattatgtgcaaatcaatttttaaaaatcaaaatctatgttaaacacattttggcagtgtgctataataaaaaaaagtgttgtgtcaaagctttctagtgacggtcagtcctactgctgtatgtcaggtttgctcacaatgaggtattcccacatagaaataacaatgcatgtattacccagaatttaatgttgcgtaccttatgttcaatgaggttttgtaatttttttaggctgatgattaaaattctttctctctaa

SEQ ID NO: 767 - DNA, 3577 bp, Homo sapiens
  ENST00000525123
gggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagagactttcactcttgcctgggctggatgcagtggcgcggcctcagctcactgcaacctccacctcccagattcaaggattctcctgcctcagctttccgagtagctgggattacagattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccagaagataatactctactgtttgaatcaaggtttgagagtgggaatctgcaaaaagctgtcagagtagacacctatgagtatgaactcaccttgcgaactgacctctacactaacaaacacactcagtggttttattttcgtgttcagaacaccagaaaagatgctacctatcgcttcaccattgtcaacttgctaaaacccaagagtctttatactgtagggatgaagccactcttgtactcccaattggatgccaacacccgcaatattggctggaggagagaaggaaatgaaatcaagtactacaagaacaacacggatgatgggcagcagcccttctactgtctcacgtggaccattcagtttccatatgaccaggacacttgcttctttgcacacttctacccatatacatacactgatttgcaatgctacctcctgtcagtggcaaacaaccctatccagtctcagttctgcaagctccaaactttatgcaggagcctagcaggaaataccgtttacttgctcaccatcaccaacccatcccagacccctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagacttcttgaagaaagagaggttctgttgtattgtgatttccatggccacagtcgtaagaataatatcttcctgtatggctgtaataacaacaatcgcaaatactggcttcatgaacgagtctttcctttaatgttatgcaaaaatgcaccagataagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaatgaagttcactcagtgtctagcagagcttaaggagcttttacgacaggaaatccacaagaaattccatgaacttggacaagatgtagatttagaaggaagttggagtgacatctctttgtctgacattgaatccagcaccagtggctctgacagttctctctcagatggtcttcctgttcacctagcaaacatagcagatgagctgactcagaaaaagaagatgtttaagaagaaaaaaaagaagtcacttcagactaggaaacagcgaaatgagcagtatcagaaaaaaaatttgatgcagaagttaaagttaacagaagatacctcagaaaaggcaggatttgcttctactctgcaaaagcagccaacctttttcaaaaactcagagaattccagttttttaccaatgaaaaatgaaaacccaaggttaaatgagacaaatttaaatagaagagacaaagacacccccctggacccatcaatggccaccctgattctgcctaagaataaagggagaatgcagaataagaagccaggctttacagtatcatgctctccaaagagaaccataaactccagccaagagccagctccaggtatgaagccaaactggcctaggagcagatatcctgccacaaagagaggctgtgctgccatggcggcatacccatccttgcacatatacacatacccgtaggtgagcctgggctgtgccacacaagcacttcatcgggggttttgagattagacacattttataatgggggagatgtatgactgggaactgcatttacttgtggtatactgtgttgtgcactcatgcactgaccttacactttgtacttacactgtgggcatgtggtcaagatgcatacctcatgaattcaactattttttcataaaatgaaattttattatgatgtgtaaaaatgctttatcagaaactgaagtgtgttctcatggcacacttcatggcagcacagatatacctcattttaaccaatagatattctctctaaaattatgtgcaaatcaatttttaaaaatcaaaatctatgttaaacacattttggcagtgtgctataataaaaaaaagtgttgtgtcaaagctttctagtgacggtcagtcctactgctgtatgtcaggtttgctcacaatgaggtattcccacatagaaataacaatgcatgtattacccagaatttaatgttgcgtaccttatgttcaatgaggttttgtaatttttttaggctgatgattaaaattctttctctctaa

SEQ ID NO: 768 - DNA, 2929 bp, Homo sapiens
  ENST00000528244
agactacccgggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagagattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccagaagataatactctactgtttgaatcaaggtttgagagtgggaatctgcaaaaagctgtcagagtagacacctatgagtatgaactcaccttgcgaactgacctctacactaacaaacacactcagtggttttattttcgtgttcagaacaccagaaaagatgctacctatcgcttcaccattgtcaacttgctaaaacccaagagtctttatactgtagggatgaagccactcttgtactcccaattggatgccaacacccgcaatattggctggaggagagaaggaaatgaaatcaagtactacaagaacaacacggatgatgggcagcagcccttctactgtctcacgtggaccattcagtttccatatgaccaggacacttgcttctttgcacacttctacccatatacatacactgatttgcaatgctacctcctgtcagtggcaaacaaccctatccagtctcagttctgcaagctccaaactttatgcaggagcctagcaggaaataccgtttacttgctcaccatcaccaacccatcccagacccctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagacttcttgaagaaagagaggttctgttgtattgtgatttccatggccacagtcgtaagaataatatcttcctgtatggctgtaataacaacaatcgcaaatactggcttcatgaacgagtctttcctttaatgttatgcaaaaatgcaccagataagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaatgaagttcactcagtgtctagcagagcttaaggagcttttacgacaggaaatccacaagaaattccatgaacttggacaagatgtagatttagaaggaagttggagtgacatctctttgtctgacattgaatccagcaccagtggctctgacagttctctctcagatggtcttcctgttcacctagcaaacatagcagatgagctgactcagaaaaagaagatgtttaagaagaaaaaaaagaagtcacttcagactaggaaacagcgaaatgagcagtatcagaaaaaaaatttgatgcagaagttaaagttaacagaagatacctcagaaaaggcaggatttgcttctactctgcaaaagcagccaacctttttcaaaaactcagagaattccagttttttaccaatgaaaaatgaaaacccaaggttaaatgaggtagtatttttgtttttgactctttgtcacacagattctctaacctctcgaattagcacctctctcccacaatgtgacaaatgtaatagccatttacgttaccctaacctgacagtgccactgggagcaagaaaacattaaaactgggggagacattgacactgctttggattagacatgactgaagtctggaatcaaatattggtgatttgtgattttacaccaagaacataagaacaggctgccttacttaccatccattcatccctctactcacccatctactcaatcagcaaatgttattttaaaataaatcaatgaattttattgggcacctacta

SEQ ID NO: 769 - DNA, 2617 bp, Homo sapiens
  ENST00000529712
acagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgggaagtttctgctctccttccccgctcctacccttaggaaaccccctcaccacctgccccagaccaggttcctctgaaccctaaattcaatctttagggcccactttcccaaccccctgacctttttccatcggcacctaccgagacgacttcgtcgcgtgctcccatacccatttctttcactttcctgtggcgagcatctcctttctcagggaaagggaagcatggggccagcaccttgggaagaagaagcgggaagatacgctgccctccctgtctcagatgcacctctggcctcggcgtgaccaccttgtttagctgaggagaagctgggttggcagggttttctgaagtcaagagggagctggggggcgcccggggaggtattggcagttttttcacttgtcctcttgtggctttgtagcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccagaagataatactctactgtttgaatcaaggtttgagagtgggaatctgcaaaaagctgtcagagtagacacctatgagtatgaactcaccttgcgaactgacctctacactaacaaacacactcagtggttttattttcgtgttcagaacaccagaaaagatgctacctatcgcttcaccattgtcaacttgctaaaacccaagagtctttatactgtagggatgaagccactcttgtactcccaattggatgccaacacccgcaatattggctggaggagagaaggaaatgaaatcaagtactacaagaacaacacggatgatgggcagcagcccttctactgtctcacgtggaccattcagtttccatatgaccaggacacttgcttctttgcacacttctacccatatacatacactgatttgcaatgctacctcctgtcagtggcaaacaaccctatccagtctcagttctgcaagctccaaactttatgcaggagcctagcaggaaataccgtttacttgctcaccatcaccaacccatcccagacccctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagacttcttgaagaaagagaggttctgttgtattgtgatttccatggccacagtcgtaagaataatatcttcctgtatggctgtaataacaacaatcgcaaatactggcttcatgaacgagtctttcctttaatgttatgcaaaaatgcaccagataagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaatgaagcaccagtggctctgacagttctctctcagatggtcttcctgttcacctagcaaacatagcagatgag

SEQ ID NO: 770 - DNA, 1288 bp, Homo sapiens
  ENST00000532595
agactacccgggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccagaagataatactctactgtttgaatcaaggtttgagagtgggaatctgcaaaaagctgtcagagtagacacctatgagtatgaactcaccttgcgaactgacctctacactaacaaacacactcagtggttttattttcgtgttcagaacaccagaaaagatgctacctatcgcttcaccattgtcaacttgctaaaacccaagagtctttatactgtagggatgaagccactcttgtactcccaattggatgccaacacccgcaatattggctggaggagagaaggaaatgaaatcaagtactacaagaacaacacggatgatgggcagcagcccttctactgtctcacgtggaccattcagtttccatatgaccag

SEQ ID NO: 771 - DNA, 538 bp, Homo sapiens
  ENST00000526331
agaagaatctgctctaacatgggagaggccagggagcagccttggcctctgtttctaacaccattcaaaacttctctctaaatctactttggattacagggcctatcagtttatcttcagctgtgcacagacagatagaagccatcaacagagattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccaga

SEQ ID NO: 772 - DNA, 552 bp, Homo sapiens
  ENST00000530577
aacaacgctcatgtactttttgttgagtctattatggtttgaaaacattatcttgattgaagtggcctttcctttcacagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagagattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatc

SEQ ID NO: 773 - DNA, 901 bp, Homo sapiens
  ENST00000532835
taaccctcaatgcctgttgaatggctctcttggggaaaaagatgatttgataccagacaccctgcaaaaggagaagcttctatggcctatcagtttatcttcagctgtgcacagacagatagaagccatcaacagaggtatttcatgtccttccagaccagaagattcaagctccttttttggactatgtcttcatcacctgctgttcccaccagacctaagaattaccagacaggaatgggattcatgcctgatgagcactgaaggaccctcagcctttagttccccctttcatttccatttttttcttttttcctcattccctttcttctttttctttttcttttttttttttttttgacacagactttcactcttgcctgggctggatgcagtggcgcggcctcagctcactgcaacctccacctcccagattcaaggattctcctgcctcagctttccgagtagctgggattacaggcatgtgccaccacgcccagctaatttttatgtttttagtagagacaggatttcaccacgttggccaggctggtctcgaactcctgaactcagatgatcagcccgcctcagcctcccaaagttctgggattacaggcttgagccaccacgcctggcccctcctttcttttttatcttcctgaaagcctttcttttcttcccttttttctcattctttctttcccaagagctcttcctctcttctgccccatctcatgccttctctccccttcctctttccatcttctttgttttatgtctgtctttcctttgtatggttatattatggccctgaaattttatttatagattatttcactatagttgataaaaaagaagaaaaaaagaataaagttttatgtaattttttctaaaatgctaa

SEQ ID NO: 774 - DNA, 550 bp, Homo sapiens
  ENST00000528632
ggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaaggatctcgctctgtcactcaggctggagggcagtggcctccacatcccaggctcaagcaaccctcccagcctttggctatcattttctgagttccaacacagcccttgtagcttcagaatctttctgcctgccaagtcctttctcactccactacaccaggctgcttctcaagtctcctcttcacatccatttcctcagctgtaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagag

SEQ ID NO: 775 - DNA, 927 bp, Homo sapiens
  ENST00000529154
gctttcggttgctagactacccgggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgggaagtttctgctctccttccccgctcctacccttaggaaaccccctcaccacctgccccagaccaggttcctctgaaccctaaattcaatctttagggcccactttcccaaccccctgacctttttccatcggcacctaccgagacgacttcgtcgcgtgctcccatacccatttctttcactttcctgtggcgagcatctcctttctcagggaaagggaagcatggggccagcaccttgggaagaagaagcgggaagatacgctgccctccctgtctcagatgcacctctggcctcggcgtgaccaccttgtttagctgaggagaagctggcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagag

SEQ ID NO: 776 - DNA, 592 bp, Homo sapiens
  ENST00000531835
agactacccgggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagtgaaaagtacttcctttccccattgatctgcgggtcacctctgtcaagtagacagcatcacttaatacaaagctcagagaggcagtttaccaaactctgctacgcatcagcatgttcggaagaataaccctcaatgcctgttgaatggctctcttggggaaaaagatgatttgataccagacaccctgcaaaaggagaag

SEQ ID NO: 777 - DNA, 479 bp, Homo sapiens
  ENST00000530969
gcttcctgctttcggttgctagactacccgggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgggaagtttctgctctccttccccgctcctacccttaggaaaccccctcaccacctgccccagaccagcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaag

SEQ ID NO: 778 - DNA, 305 bp, Homo sapiens
  ENST00000425363
cctctggcctcggcgtgaccaccttgtttagctgaggagaagctgggttggcagggttttctgaagtcaagagggagctggggggcgcccggggaggtattggcagttttttcacttgtcctcttgtggctttgtagcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccg

SEQ ID NO: 779 - DNA, 3295 bp, Homo sapiens
  ENST00000357610
atgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagagactttcactcttgcctgggctggatgcagtggcgcggcctcagctcactgcaacctccacctcccagattcaaggattctcctgcctcagctttccgagtagctgggattacagattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccagaagataatactctactgtttgaatcaaggtttgagagtgggaatctgcaaaaagctgtcagagtagacacctatgagtatgaactcaccttgcgaactgacctctacactaacaaacacactcagtggttttattttcgtgttcagaacaccagaaaagatgctacctatcgcttcaccattgtcaacttgctaaaacccaagagtctttatactgtagggatgaagccactcttgtactcccaattggatgccaacacccgcaatattggctggaggagagaaggaaatgaaatcaagtactacaagaacaacacggatgatgggcagcagcccttctactgtctcacgtggaccattcagtttccatatgaccaggacacttgcttctttgcacacttctacccatatacatacactgatttgcaatgctacctcctgtcagtggcaaacaaccctatccagtctcagttctgcaagctccaaactttatgcaggagcctagcaggaaataccgtttacttgctcaccatcaccaacccatcccagacccctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagacttcttgaagaaagagaggttctgttgtattgtgatttccatggccacagtcgtaagaataatatcttcctgtatggctgtaataacaacaatcgcaaatactggcttcatgaacgagtctttcctttaatgttatgcaaaaatgcaccagataagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaatgaagttcactcagtgtctagcagagcttaaggagcttttacgacaggaaatccacaagaaattccatgaacttggacaagatgtagatttagaaggaagttggagtgacatctctttgtctgacattgaatccagaaacagcaccagtggctctgacagttctctctcagatggtcttcctgttcacctagcaaacatagcagatgagctgactcagaaaaagaagatgtttaagaagaaaaaaaagaagtcacttcagactaggaaacagcgaaatgagcagtatcagaaaaaaaatttgatgcagaagttaaagttaacagaagatacctcagaaaaggcaggatttgcttctactctgcaaaagcagccaacctttttcaaaaactcagagaattccagttttttaccaatgaaaaatgaaaacccaaggttaaatgagacaaatttaaatagaagagacaaagacacccccctggacccatcaatggccaccctgattctgcctaagaataaagggagaatgcagaataagaagccaggctttacagtatcatgctctccaaagagaaccataaactccagccaagagccagctccaggtatgaagccaaactggcctaggagcagatatcctgccacaaagagaggctgtgctgccatggcggcatacccatccttgcacatatacacatacccgtaggtgagcctgggctgtgccacacaagcacttcatcgggggttttgagattagacacattttataatgggggagatgtatgactgggaactgcatttacttgtggtatactgtgttgtgcactcatgcactgaccttacactttgtacttacactgtgggcatgtggtcaagatgcatacctcatgaattcaactattttttcataaaatgaaattttattatgatgtgtaaaaatgctttatcagaaactgaagtgtgttctcatggcacacttcatggcagcacagatatacctcattttaaccaatagatattctctctaaaattatgtgcaaatcaatttttaaaaatcaaaatctatgttaaacacattttggcagtgtgctataataaaaaaaagtgttgtgtcaaagctttctagtgacggtcagtcctactgctgtatgtcaggtttgctcacaatgaggtattcccacatagaaataacaatgcatgtattacccagaatttaatgttgcgtaccttatgttcaatgaggttttgtaatttttttaggctgatgattaaaattctttctctct

SEQ ID NO: 780 - DNA, 5546 bp, Homo sapiens
  ENST00000291572
gggcggcgggatgggggccgggggcggcgggcgccgcactcgctgaggccccgacgcagggccgggccgggcccagggccgaggagcgcggcggccagagcggggccgcggaggcgacgccggggacgcccgcgcgacgagcaggtggcggcggctgcaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggaaggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatgaatgtttgaattttttttttttgggggggggagggtggattttgcttttcatccagaaggaaaaggggaggagagctcctttacattttttaaattaaattcataaatcccagaacagtcttttttttttctttttcctttacaccctacttctgagcttaattcagttgatgttatgtccaaattcaggctgagtgctcaggctgaagcaactctgtagcccacagtccgtgctggccactgtcggggtgaggcacattctaggcctggcatcgctgatgccctctgcacccagtccttgagccaggccgaggacaggaagggcattgctggcctgtagctcctgttacccacccagagccaggcgccacactggaggctcccaggcgggagggcccaggcccacccacgggcgtctggccggtcaagctcccagcctgggccgtggtctcctggggacgccgctggcctcccagcttaggcccaggtgccaggtgtcatggggtctcctgcccatcttcccaaggatgccattgctgtcttcatcgtcttcccccgtgtgagacactggttgtctggtactcggcgacagtgtaccagacgcgcaccctatgtgaggtgctttaaggtccctgtcctcaggaagcgcagtctggtggaagagatgagcgctgaacaaatcactaaataacacaaaacaacaatgtaagcagcactttcttgtgtaaaaaaaaaaaaaaagcacgtcctgtcgatgaattttgagtctctctgccttgcctgtcccgactccctttcgcgcaccgtggcatgagaatctttcctcacgctgttcgttgcggtattgctgagcattgatgttgatttgaaggaaaagccgtggttggacccagctgtgtgtttcactcacgtgcaattgagtagctgttgccaggctgtccatgcctgttgtgactaccggttggggtcagatttggggtgaagaatgagtaagtttctgcatgctttgtctctacctgagacacttctacaacaagccaagtataatctctccagccctgcagattttcacctgacttgttcagccccatgcgtagactcccgctgcaggcctctggcctgtggctcactgcatgcagcccctggcgtgcaatactagtgctccacggcgcgatgtgcttctagcccttgcactgcacctaggctcagggttcaaacggccagcccgaaaagcctgcctgccttctttctggaaacagcacgtccccggccgtgtgcctgcccctttctctactgagctagtccccaaaccaaaggcaagccccctcgggcctcgggggatggggccggccacacccctgactccgccctggctctgccccatacccctgccgtggggccgacctgggggatgcagacatccggctccgtattcctgcctatcggggccaggatgcaaaaacaatttttgcgtaaaagatgtcacactgatctgctggagtggggtggacacatgaattcagttttatcatgaacactcgccactggctgcttgttaattcagggataatggtggcattcttacaaactgctcgggaaatagaatgacgggaacacttttagggagcccaggaagttaccagggacattggtgtcgccggcccaggcaacagcagcgtacgcttttcaaagatcattgagttgtcttagaatttgaagctgtgtaatgacaatgtcacctggagttcgtctccatttcttaactttttgttgcacaagtatttggacagaagtcgaactgtgaatgagatactgaaatgcactaaattgtattacattaaactggagttacttgatacaatgaa

SEQ ID NO: 781 - DNA, 427 bp, Homo sapiens
  ENST00000474735
ggcgttagcctgtgcctgttacaactcgcttcttgtatccatttctgacacgtgactgatacacctgcctcccatcccctccgcactttgacctcgtaaacaagtgatctgacacaacagggcttgagttacttgcccgaggttgtgtcacggaacggcagggccgcctttaggcttacatccctggaactcccacctccacagacccgtccgggtgctgaaagtccacggatgctatccctggtcaaatcagagccccgcttaggctctcacattgcagaccccacggcagagcccctagtgcttggcactgaagagccagtgcaggcccgttgtcaccatcaaaacccacctctggtatcgccggtggactggtgtttctagatcgcagcgtgggacgtgattggctacatttgactgtttcctt

SEQ ID NO: 782 - DNA, 454 bp, Homo sapiens
  ENST00000448287
cggaacggcagggccgcctttaggcttacatccctggaactcccacctccacagacccgtccgggtgctgaaagtccacggatgctatccctggtcaaatcagaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccagg

SEQ ID NO: 783 - DNA, 3595 bp, Homo sapiens
  ENST00000398061
tctatgaaaccaacatacatggcgtttgcatcacagttggagtcagatgtgagcccggagggcaggtgtctggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggaaggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatgaa

SEQ ID NO: 784 - DNA, 3589 bp, Homo sapiens
  ENST00000327505
atttggtcacacggcgtctctccagtcctgcgcaagcacgttgacatgtgtgcctttcactttcaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggaaggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatgaa

SEQ ID NO: 785 - DNA, 582 bp, Homo sapiens
  ENST00000445582
atatgtctgacagccttgtgtgcttatttcttgcccgcgtgttctgtctcgggttggaagggacacgcacgtctcctgccttcacatgctgagatgggtttctgtagcatccccagaatttctgctgaatgaagtgtgtcgggttatttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctac

SEQ ID NO: 786 - DNA, 5767 bp, Homo sapiens
  ENST00000398063
cgccgacacatggtcgttcgacttctggcttggcctcttttgtgagtgtggggcctggtcatatcctcttggtcagtgtctctgtgatgatgagaacgggaagacggccacggtgcccaccctggcaggactctctcccctcgctggcgctggctcagctgccgtgagcggccgtaggcactgtcccgggccctcctgtggttgctcccagccatgctgctggctgcttctgccgtcctggcttgcagagactctgggtcatgcggggaagagggcagagtcctcctccctgctcaggcaagagaggatccagcaagatttcttcctccccaccctcctgcccctcccagtctgggcagcagataaaagccagggccccacacttctgccacctcctgctgctcacacactccagccagggacctgcccccggggtccaacaaggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggaaggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatgaatgtttgaattttttttttttgggggggggagggtggattttgcttttcatccagaaggaaaaggggaggagagctcctttacattttttaaattaaattcataaatcccagaacagtcttttttttttctttttcctttacaccctacttctgagcttaattcagttgatgttatgtccaaattcaggctgagtgctcaggctgaagcaactctgtagcccacagtccgtgctggccactgtcggggtgaggcacattctaggcctggcatcgctgatgccctctgcacccagtccttgagccaggccgaggacaggaagggcattgctggcctgtagctcctgttacccacccagagccaggcgccacactggaggctcccaggcgggagggcccaggcccacccacgggcgtctggccggtcaagctcccagcctgggccgtggtctcctggggacgccgctggcctcccagcttaggcccaggtgccaggtgtcatggggtctcctgcccatcttcccaaggatgccattgctgtcttcatcgtcttcccccgtgtgagacactggttgtctggtactcggcgacagtgtaccagacgcgcaccctatgtgaggtgctttaaggtccctgtcctcaggaagcgcagtctggtggaagagatgagcgctgaacaaatcactaaataacacaaaacaacaatgtaagcagcactttcttgtgtaaaaaaaaaaaaaaagcacgtcctgtcgatgaattttgagtctctctgccttgcctgtcccgactccctttcgcgcaccgtggcatgagaatctttcctcacgctgttcgttgcggtattgctgagcattgatgttgatttgaaggaaaagccgtggttggacccagctgtgtgtttcactcacgtgcaattgagtagctgttgccaggctgtccatgcctgttgtgactaccggttggggtcagatttggggtgaagaatgagtaagtttctgcatgctttgtctctacctgagacacttctacaacaagccaagtataatctctccagccctgcagattttcacctgacttgttcagccccatgcgtagactcccgctgcaggcctctggcctgtggctcactgcatgcagcccctggcgtgcaatactagtgctccacggcgcgatgtgcttctagcccttgcactgcacctaggctcagggttcaaacggccagcccgaaaagcctgcctgccttctttctggaaacagcacgtccccggccgtgtgcctgcccctttctctactgagctagtccccaaaccaaaggcaagccccctcgggcctcgggggatggggccggccacacccctgactccgccctggctctgccccatacccctgccgtggggccgacctgggggatgcagacatccggctccgtattcctgcctatcggggccaggatgcaaaaacaatttttgcgtaaaagatgtcacactgatctgctggagtggggtggacacatgaattcagttttatcatgaacactcgccactggctgcttgttaattcagggataatggtggcattcttacaaactgctcgggaaatagaatgacgggaacacttttagggagcccaggaagttaccagggacattggtgtcgccggcccaggcaacagcagcgtacgcttttcaaagatcattgagttgtcttagaatttgaagctgtgtaatgacaatgtcacctggagttcgtctccatttcttaactttttgttgcacaagtatttggacagaagtcgaactgtgaatgagatactgaaatgcactaaattgtattacattaaactggagttacttgatacaatgaa

SEQ ID NO: 787 - DNA, 4338 bp, Homo sapiens
  ENST00000398058
attgtgcagtcatcaggccctgggagctttccacatccctccacctcccacccaacatcaccactctccggccagtgagaccatcacagcaccccagaggagacaaattctggagctcagagagctgggtggctcctgcaccttcagacactgcctcctcaccgagggagggaagaacgacaaaggacctccaggacgtagaggttgatgatccgggcaggtggccttcagcgagggagcacgtcaaaaggctgtgggccgtgcagacagctgggggacaccgtcccgggtgtgaccttgggccacacggcagggtggtggacttgctcctagaattgggctccagggctgaagccagcccctctgatctggcactggccggctccattcaccctttttggggcttactgccgcagagacttcctttgaggagagctggacccaagacgccagagttccgggggcactgagtgctgtgtggcacccgggccaggagaaacatgtgccagagggcaggcgtgggctctccggggagtctctgcgtagactttctagcccagaggttcaggtgatggaccagagactggccgctttgtgacaccgaggacggttgataaagtggattctcgaggggaagctgcatccacacagaggctgggacgtgaatgtgcatcacggctctatctgtggcccccaaaggctgggtgccagctgcctgtcggcagggagcgtatcaccgtggcacgtccatgccgtgggggtcactcagcagccacggatgcgccctgggtgctgtcccggggccgtctcagaagcaccgcgctggaccggctgggccagatgccatgggattctgtgtttgtgaacctctagaaaaggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggaaggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatgaa

SEQ ID NO: 788 - DNA, 924 bp, Homo sapiens
  ENST00000457068
tgggagctttccacatccctccacctcccacccaacatcaccactctccggccagtgagaccatcacagcaccccagaggagacaaattctggagctcagagagctggggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgag

SEQ ID NO: 789 - DNA, 392 bp, Homo sapiens
  ENST00000448845
gagaccatcacagcaccccagaggagacaaattctggagctcagagagctgggagggcagctgctggtgtgacctcagctgctccccagaccctaaggggatctgggaccttccaccttctaccaacggtgttggtcttctgtcctcacgcctatggtttcacgctcccacagtggctcctgcaccttcagacactgcctcctcaccgagggagggaagaacgacaaaggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctct

SEQ ID NO: 790 - DNA, 791 bp, Homo sapiens
  ENST00000498670
ccatcacagcaccccagaggagacaaattctggagctcagagagctgggagggcagctgctggtgtgacctcagctgctccccagaccctaaggggatctgggaccttccaccttctaccaacggtgttggtcttctgtcctcacgcctatggtttcacgctcccacagtggctcctgcaccttcagacactgcctcctcaccgagggagggaagaacgacaaaggtgatgaccagaggacctccaggacgtagaggttgatgatccgggcaggtggccttcagcgagggagcacgtcaaaaggctgtgggccgtgcagacagctgggggacaccgtcccgggtgtgaccttgggccacacggcagggtggtggacttgctcctagaattgggctccagggctgaagccagcccctctgatctggcactggccggctccattcaccctttttggggcttactgccgcagagacttcctttgaggagagctggacccaagacgccagagttccgggggcactgagtgctgtgtggcacccgggccaggagaaacatgtgccagagggcaggcgtgggctctccggggagtctctgcgtagactttctagcccagaggttcaggtgatggaccagagactggccgctttgtgacaccgaggacggttgataaagtggattctcgaggggaagctgcatccacacagaggctgggacgtgaatgtgcatcacggctctatctgtggcccccaaaggctgggtgccagctgcctgtcggcagggagcgtatcacc

SEQ ID NO: 791 - DNA, 1003 bp, Homo sapiens
  ENST00000422850
tcctgggctcgtttctgccccaggtagtgctgtcagcggcatgcctgccttctgcaagcccctcttccctgttccccagcccgcacttccaatgagctgtgggccaggaaaccagcccgtcacacttgtccacgctgcgtttaaagcgggaggaaggaggacccaatgcagggcccgaaaggtccactgacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgag

SEQ ID NO: 792 - DNA, 773 bp, Homo sapiens
  ENST00000497909
gtgctgtcagcggcatgcctgccttctgcaagcccctcttccctgttccccagcccgcacttccaatgagctgtgggccaggaaaccagcccgtcacacttgtccacgctgcgtttaaagcgggaggaaggaggacccaatgcagggcccgaaaggtccactgacctccaggacgtagaggttgatgatccgggcaggtggccttcagcgagggagcacgtcaaaaggctgtgggccgtgcagacagctgggggacaccgtcccgggtgtgaccttgggccacacggcagggtggtggacttgctcctagaattgggctccagggctgaagccagcccctctgatctggcactggccggctccattcaccctttttggggcttactgccgcagagacttcctttgaggagagctggacccaagacgccagagttccgggggcactgagtgctgtgtggcacccgggccaggagaaacatgtgccagagggcaggcgtgggctctccggggagtctctgcgtagactttctagcccagaggttcaggtgatggaccagagactggccgctttgtgacaccgaggacggttgataaagtggattctcgaggggaagctgcatccacacagaggctgggacgtgaatgtgcatcacggctctatctgtggcccccaaaggctgggtgccagctgcctgtcggcagggagcgtatcaccgtggcacgtccatgccgtgggggtcactcagcagccacggatgcgccctgggtgctgt

SEQ ID NO: 793 - DNA, 1510 bp, Homo sapiens
  ENST00000479117
cacgctggcgctctggccggtcagcaagcagctctaccgccgcctcaactgccgcctcgcctactcactctggagcctagcacaaaactagaagcaacccaagcacctgtcactggagactaattatgcggcacccatacagggaccctctgcggccatcatggagagccttcatcttgcccgtacagttttaagcgaaaaaggaagtatacaacaaagtccataaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaatttt

SEQ ID NO: 794 - DNA, 616 bp, Homo sapiens
  ENST00000481319
ggcgctctggccggtcagcaagcagctctaccgccgcctcaactgccgcctcgcctactcactctggagcctagcacaaaactagaagcaacccaagcacctgtcactggagactaattatgcggcacccatacagggaccctctgcggccatcatggagagccttcatcttgcccgtacagttttaagcgaaaaaggaagtatacaacaaagtccatagtgtctcctgtgggcgctccctgaccatcccaggaggaggggtcctaccagtgccaacgccctccccctgtccgcagaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactacccc

SEQ ID NO: 795 - DNA, 3955 bp, Homo sapiens
  ENST00000467358
ttatgtttgtttgtttttgagacagggtcttgctctgtcgcccaggctggagtgcagtggtgtgatcttggctcactgcaatctctgcctcctgggctcaagcagtcctcctacctcagcctccttgagtagctgagaccacaggtgtgcaccatcatgcccagctaatttttgtattttttgtagagacagggttttgccatgttgcccagactggtctccaactcctaggctcatgtgatcctcctgcctcagcctgctgggctgctgggattacaggctgagccaccgcaccagccacagtgttttctgatgaccctgaaccacggttttattttcaattcttcattcctgttctcattccttaatgctgggtgccttcttgctgcccattttgaactcactgccagtgtgtctctgctgtcatctgatgtgcagagctataggtgctgcggcgaagggtgcaggtttggagccgtttaaacaacctggcccagcctcctcactccctgctgaccttggtcaaggcttcagtctctaaacctcagctttctcatctgcagagcacagacaaaaccacctgcctttgagctgtcttataaagcctaaatcaatgcgcacagcaggtacacagcaatgcttgataaattgttactattattgggtgaattttaggttttttttgttgttgttgttgttttgagacagagtctctctgttgtcctggctggagcacagcagtgcgatcttggctcactgcaacctccatcttctgaggttcaagtgattctcgtgccccagcctcccaagtagctgggattacaggtgcctgccaccacatccagctaattttttttatttttaagtagagatgggcttttgccatgcttccccagctggtcttgaactcctggcctcaagtgatcctcctgtctcggcctcccaaagtgctgggattacaggcttgagccaccgcacccgtccagaattttagatttttttaaatccgtggttgaaaaataggctatggctggcttactcattgtgctttagggaagcatgtatttgagtgaaggaaatgataaaaggaatttcatatcgggcccaggcgccgcccaccctgcaagacagtttacagatgcctgccctgacagctgtctgcagttagccagcgtcagccgaggggtcctgagatccgctgaaggctgcctttgcatgccgacagcaagggaaaagtgccacatgtccctgggcttgccacaggtgacctttggatgggaccattctccagacagcgcagctcgtctttccagaacactcatggggagtgtgcctgtgtctggctggctgtgtgggctcccattcagttcattccccttctccagcctttaggcatgaccctaaaggcagaggtctcaagcacttgccaggggtgagccagcggtgggggcgcccctgccagggcaggcctgctgtgggggcttggtcagcgagtcttctccccacacgcaggatttcctcccgtccactgcctctgcccacaggtgacctttctcttttaaaggaattggggtcccttggtacccccacaaaccctgagttccctctctcctttctgcgtcctttctgctcgcctgcatgtgcctgcagcatcatgaccgctgggaagacacttccctgcacctgcacgctgtctgcaggcgtctctggccatcctgggctgagctgcgtgatctcgggtagcggccctttgttcacccgtgcaggatgtctttggaattggtctctagtgtcctttataaataactggtataaaagaaccccgggcaatggccttgcagaaagcccacacttcagagctgggctggtgtccagcgcgagaagcctgaggccgtcctgagctggaagccgcgtcctggttctgtggggccatccttcccggacaactggctggggggcacaagactctggtggccgacaagaggcccacctgcttggcctccctcttgtccttccccacatggccctctgaacaggactaactccctctgaggcccacgtgtgacaaagatgcaccgttctcaccacggaactcttcagccctgcagttctcccgaaggtgaatgagggcatcccagagtccccatcaggagacagacgatgctgcgttcccagcagccccagagccctcccaggcgtgcaggtctcctgccggcaaacagatctcccggcacgagcccctccacacttctgggaagagtgtcttcagctcaccaggccggagccaggggaagagaccaagggaggaggctccaagaacccctgggtgggggggacaagcactcaaagccaggactggcacccctcacatgccagcacccacggggtcaggtgtgccctgctgtctctggggaccccgcaggcctctggccacctgcccagcagcaagccccgtcgagcacccccagccggccttcctgggggcgggctaggcctcacatggcttttttttaaatatggaaaaccagtgtaaccccaaagcaagttttaggagaaaatataattcctattactctgtcgtctataattccattctgctcttaactcttcattttttcccactgtctgttctgcagacatacgatggttgttttctgcttcctaatcatctagtgacatttttcatcttctgcacctctcacggggcgtggctgtgcggtactcggccacaccaaggtgcacgtgagaagcgtaattgggcgtaaagatcagcgtctccatgcagagtggcggttctctccctttctgctgctaccttccatctgtctcctcccaactgttgcttagagaaagttattgtaatttcataaaacgtactcagtgtaagtcatcaaaactcatgtttagcagagacttcctctctggacaaaaatactgtaggtgtctcctgtgggcgctccctgaccatcccaggaggaggggtcctaccagtgccaacgccctccccctgtccgcagaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagttt

SEQ ID NO: 796 - DNA, 588 bp, Homo sapiens
  ENST00000484865
atgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcaggtaatggacactgtcgctaacagctcacactctgacgggcctcacagtatcagccacagggtccgggacctggtgactcatcacagtggctgtgggaggcaggggcctggctgttatggaccctggagccaggatccccccacggcctgcgggcctcagagcctggattcttgcactgagctgagggtcgcctccccagagagccgaacggccgccacctggcgc

SEQ ID NO: 797 - DNA, 2199 bp, Homo sapiens
  ENST00000546158
aggacctccaggacgtagaggttgatgatccgggcaggtggccttcagcgagggagcacgtcaaaaggctgtgggccgtgcagacagctgggggacaccgtcccgggtgtgaccttgggccacacggcagggtggtggacttgctcctagaattgggctccagggctgaagccagcccctctgatctggcactggccggctccattcaccctttttggggcttactgccgcagagacttcctttgaggagagctggacccaagacgccagagttccgggggcactgagtgctgtgtggcacccgggccaggagaaacatgtgccagagggcaggcgtgggctctccggggagtctctgcgtagactttctagcccagaggttcaggtgatggaccagagactggccgctttgtgacaccgaggacggttgataaagtggattctcgaggggaagctgcatccacacagaggctgggacgtgaatgtgcatcacggctctatctgtggcccccaaaggctgggtgccagctgcctgtcggcagggagcgtatcaccgtggcacgtccatgccgtgggggtcactcagcagccacggatgcgccctgggtgctgtcccggggccgtctcagaagcaccgcgctggaccggctgggccagatgccatgggattctgtgtttgtgaacctctagaaaaggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatc

SEQ ID NO: 798 - DNA, 7865 bp, Homo sapiens
  ENST00000320285
gctttttctttccagtgttggctgacttacagctcttataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagtttcagctgtatatgactgtacactcaatttcagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaaggatgcctttcaggaggagtactacaggacgggcaccttcccagagacgcccatggtgcccccccggcggccctggaccctcgtgaactggctgttttgggcctcgctggtgctctaccctttcttccagttcctggtcagcatgatcaggagcgggtcttccctgacgctggccagcttcatcctcgtcttctttgtggcctccgtgggagttcgatggatgattggtgtgacggaaattgacaagggctctgcctacggcaactctgacagcaagcagaaactgaatgactgactcagggaggtgtcaccatccgaagggaaccttggggaactggtggcctctgcatatcctccttagtgggacacggtgacaaaggctgggtgagcccctgctgggcacggcggaagtcacgacctctccagccagggagtctggtctcaaggccggatggggaggaagatgttttgtaatctttttttccccatgtgctttagtgggctttggttttctttttgtgcgagtgtgtgtgagaatggctgtgtggtgagtgtgaactttgttctgtgatcatagaaagggtattttaggctgcaggggagggcagggctggggaccgaaggggacaagttcccctttcatcctttggtgctgagttttctgtaacccttggttgccagagataaagtgaaaagtgctttaggtgagatgactaaattatgcctccaagaaaaaaaaattaaagtgcttttctgggtcatctgtggtgtatgttgacatggaccgctgcccctccatcctgcccttgcccgtggctttggtgtttcagatcctactcacgggaggcagctgccgcggaggtgtgggcagctgagaggggtgggcaggccagcacagctcctggcaggagacacaggtccaggagcccgtgagcatttgtgagagcagagatggcaagcacgtgcgtggagaccaacgaagcgtgtccctggcacacagcaagggagagtttcgctcggtctctgcagtgcagtctcctggcgtaagtcttgaagatggacccaactccctgaagaaatggatcttgaaattgaacacaaacatcatgaacgtacagcctgggcattctgcagtgatttgtgagatgagcttgcatcgactgttcctctcagcagtgacagccaaagtcacccctgataaaatgcagtttcactttataaaatgcctcgccccttcccagcatgtagagcttgtctgcagccctaaaggagccaggtcctgctctgatgagggtcaaatcagagccgacatcccatgtacaaaaaacccccaggcttctgccttccttccgggctcctgtctgctcccattttactccacggaatagttctgccctgtagcatctccagcggcctttgcagactgctgtcagccaacaggtgccaaaaatgcaaaagaagaagaaactaaaagcagtgctatttttgcagaacaaatgctagctattaaatcatcttaggccaagacaccaatggcacttggaccgataggtatttggagcatgagttaggaaggatatgtctttctccaggtgcgcagctgaaagttgctgagaaaagctgcctgtgttgctgtggtaacatgagaaggaatgaacagctctatacaaaaactggccacacattataaggcctattctatgcagttatgtttttggctatttgctcatttagtcattgtttatcaaccaaactaggtaagccaaggagttacaagacagctctagagaagctccctctgcttacaggacaataatgcattgtttgtttgttgatacaaatgaattatttgaatccacagaagtgaaaaagggaaaaaatcctggctgacttgtgggaagagcgtactgcagagcctagggcctgagttaactcgctggcggccctgcaggcaggcttgatgggagcgcccagcacatctgcccaccctgcacagggcatgaagcaccgtgtgcagagatctgtgggcaaaagcccaggacgtgaccttaggcaagaggggtccttggagaagtggaggtgtgcatggtgtgtagccttgcgtgtctgtgagcacgccctagtggacctgcgcctggattatcgggccagtctctcggaggggtccgtgatgctgagttacgccattcacctgaactctgcagctcatcggctgtaggatttgggtgagacacttttccttgctgactcatttccccatctgcaaaatgggggtgacgatatctacctcttggggtgtgtcaagggtaaaagagcacactttaagaatcctaaagcactaagccaaggatgaaagactagaaagctgcctctatgttgctactctcaaaaatgctcagaaattttcttgtcgtactaaaaatgtgttatttttctcattttcattcttccattcaacacagaagtaatctaagtaagttctaaaaacatagatccgggggcccacagacattcaattttcttctgaattggctctggtatcacacaacacacaagcaagcaaacagcctgcctgctagggccttgggttccaggctggaggaatgcaggcagaaatctcttaggaaataactaagtgagcgccaagttttgaattgccttagagccgaaagagaatgtggcgtgctggggagagatctggacctctttctcatcagtcatttgacctgtccacgaagaacaattttgttatgcagcctgggaacctggtttccttacaccctgcgcccttaatgacacagacaaccacgggtactcctggacggaagctcatcacgcctcctcaaataccttcacccatgttcaggtcacacggaggtcaccatctcctcagcacacaacaactgctttggttcccagggttattttttctacgagttgaaaacccacggagcctaagccatctttttgtcccctaaggagagccccatagactaagagctacacttcctgtctgtctttcccacctttccatctcattctagcttaaagcttatcacgctactgagagcctgttctgtagttcaaggtggcagagaaaaatacgaaccttgagtgaaatctggagagcagtgcagggtcatccccagacgtgacgggccatatcctaggcgactcctgcagcttatagaagcagggaatttaatggacttcttccaggaaagccagcccacggggactcttaaaaagacaccaaccatttggaagatgcagcttgaggtctgggggactggactgattctgccaccatatagtgaacacgattaatcgggaggaagaagtaaggcactctgtgagttagtctaccaccctattgactttgacagagagaaaaccaacttttttcatatgatcacacagtagtactggaatatctcgactgcaatatcctctaaacaaatgcatgcaaagctttgtaaaagcagctgatgattaaaaaaattttaaaacattagggtttttctaatatatccatatgtgggacagtgatttaaatgtcattaattgtccagccacaacttgtaacagtgatgtgaaagacacaaaaaaggccccactggagtggaggagtggtctggctggtccccaagcaaaacagaatgggcttcgcataggctttagaacttattcataaatattgaccaaagtgtgaagcaaggtatccagtgaagattctctagggtctctacttctgctcaagagatttaatccagctttctctaaagcagtggtccagacttgccacatactaggttaaagataaagtgagaaaaacaaatactttggtttgcacgtctcttgaggggccctaggctgtatggaggaatatttagaggaatatttgtgagctgccatttgtgtttaaaagaacatgaaagcaagacgggccctaacccgcctgtgtctgtagctgaccaggaggccactgcttccttcccccagagcttctaggagagccccccaaaatgcaactctccaaggtcctgtggagtagtcccctcataatgcctccaccacacctgtgtctcacgatgccttaactgacgtagctcctaagtgatgttcacagagaaggaaatacttaggcaagcccatgtgtaacatgctcacagatgtgctggctttgccaatgctttcggactccaccatgctttctgattcttctggtcctagtcacgccttggcacggggcagaagcggccgagctatgctgacaggtgctgctgagagccaacagccattcagccgagaaggcgtttctaggtgagggcatgagagctggcattccaggctgctgagtgcggcatctgcaggtgcaccacattgctccacggtgtgttcagaagagaccagcatcttgaatctcaggctctgggctcattctttgcctctgccaagggaccattcaggggcttcaagccagctgctgaaaatcccccttttctggatttttccccatctatataaggatatggtggctgtgtggacaagaaattggtttcatctcagaagggtgcttccctacaaagatcttcagaaatttaattgaaaacaattttttgaactttttttgtttggccaggatgaatgaagctgaagtcacatcctgaatgtgcatgccagacaaagggtaagcaagcagtctttacaaatgccaatccctctgcactccaaaaccggagcccgtaatgaaggcccaggttccagtcatcacaggatcccccaagccagcacagtgcctgatgcctccctaggcattagcacatcccagcactctaattcacatcctcagcatccctgcctcctgcatccagggcttaggttgagtgtttccagagtgtcaagtacatttaaacacaaaccaaatactccagggttttgacctgtcacaatggcttttgaaaacaacagacgtacaatttgagagaaggactcgatggacttcttaggctgaggactaaggacatgttgctgttcctcttggtccaggacattcaataccattcacagcattcatcaccaactgacatagtatcgatcacgacattcaactgtttgaaattactgctattttggtcaaaaactaagaaatcagaaattgcacctacatagtgtgtctcctcattggagtcccatctctctgagcacagggatgggctcctgagctcacagccctgccctgcccccccagcagggcctcaccctcatggccctcagtgaatagtgactacatgaagggggcacttactagaggcctgagtaatggaatttcaattagcttctgcttcccttttctaaaaaagaaccacctttcttaagaataattaggccaaaataaacttgagtaatttgtacagtcaatattttgaagtttcggagttaccagtgaaatagcaaagctgttctccaggaaaggacatccaggttcccacccaggccttccttcctcagctcctgcagcctcatcctagtttaatatgaaggttgtgaatgggttaaaaagcagttcttaagcacctacttagatcttttcagtatctggaaatagcacccagggctgtgttagtaaagcttttcactgggtaagagtcatacaatttttacatttaatttgtttttttaaaacaaggcagtcttgttttacatattggaatgactagatattttttgacatttctggcacctctggttctgctgaattttaagggaggtgagtggtatgtacacaaagttaagattgctgcataataattcctttgcatttccaaaataaattacacaaatgtcacttttccttttctattccatagtactagttttagccagatctttgccaaacattctaggacattcagaaaagtcatccatggaattttggaatgccattctctctgtatctttgcagatcatgaggaaggaaagttgatgaactagtacgggatggctcagacttgtaaagtgtctaagtcacaacgctgcagagccagcttccgggtagcaatggcatggcctcagctgtgccaaggctacaactggagcttccttactcgcatctgaggcaaacacagcaaggctggcccaggccgcccacagtcaacagatgttcacgggagatggatcagcccctcttttgcttgttctatcaaggaaagagatctaaccatgggcaagggtggaacacacccggttcaggtcagggaatgagttgctctaagtgaacagtgaattcttacttctcagcctgtatcaattgtacccagggttcatgattactgtgacccactaagggatgatctttgaggaaacagacctggagggaggtaatttaaggagggaaagcgagtgggttttacagactgctttgtggcgacattcaggaacagaccattcaatggatgacttttcagtacataaaagcaagcagtaatggccaggagagagcaaagatgccctaagaatgacatcagactgaccaaatgtgccttttcaaataagttatgagaacgaatgaattggaattagagcaaggtattggacagaaccatgctagtctttgagagaacgtgtggattgggtggatgtttggaccgaatgaatggtaactttttaatgtgaaacagagaactgatatatgggctgtcatgtcaccctagggtactgtcgctctgtcatgtgtagcaatctttccaaatttttgttggtgggctgaacaaagataaaactaataaagtatgtgtggataccactaga

SEQ ID NO: 799 - DNA, 490 bp, Homo sapiens
  ENST00000437165
tttcagctgtatatgactgtacactcaatttcagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaagggctggggcgacaccgagttctctaagcagtatgtgtctgtgagcaggcctgggaggctggccctttgcccttccgagaagatcgctgagcagcaagtggaagtggtgcatggtttctccaagcagagtggtgaatagacatcaagggacaattcctttctgtatcagcctattttgctaggagcctagatctaaagctttacgtgccccaaatctgggtgcccgacccagtttgtcaaagtgggatttcattttaatgatcaaccttgcagtcagaagtgtggtgtatgtcaaaagacagttctgttgat

SEQ ID NO: 800 - DNA, 875 bp, Homo sapiens
  ENST00000436279
ctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggtttgacctcttgcacgtagcttgcatgcctttggaactgggtctcttcagttgacttttgtcgtcttcaacacactgcagcgtgtagcggttgagcctgtgtcacatagctgaatcagagtcatctgcggtactcagggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagaaataatgaaaatccaacactgctgggagtcctaaacggaaagaaatacca

SEQ ID NO: 801 - DNA, 942 bp, Homo sapiens
  ENST00000366905
cagctcttataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttaggggtaagtcagaagtgcattcccccctgcctcacacatttctctggttcagccccaccacttgtctttttgctcctggtcattcagaacttgcagaagaatcaacagagtttctacttgatgaaatggtcctaataaactgctttttattcttgctgggagtcagtcttaacagcttcttatgggcaatcataagaggtactcaacaattgctacctgccggccattttacatatgattcatttatttaatccttacagcaacatgaatagatgatgtgccacactccattttttaaaaactaagttatatagagcttaatattcggctcagagtcacacagctgtaattagatttggatttcactcccatccatatttcttaattccatgctctactgcctccttggctaa

SEQ ID NO: 802 - DNA, 7705 bp, Homo sapiens
  ENST00000366911
tataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagtttcagctgtatatgactgtacactcaatttcagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaaggatgcctttcaggaggagtactacaggacgggcaccttcccagagacgcccatggtgcccccccggcggccctggaccctcgtgaactggctgttttgggcctcgctggtgctctaccctttcttccagttcctggtcagcatgatcaggagcgggtcttccctgacgctggccagcttcatcctcgtcttctttgtggcctccgtgggagttcgatggatgattggtgtgacggaaattgacaagggctctgcctacggcaactctgacagcaagcagaaactgaatgactgactcagggaggtgtcaccatccgaagggaaccttggggaactggtggcctctgcatatcctccttagtgggacacggtgacaaaggctgggtgagcccctgctgggcacggcggaagtcacgacctctccagccagggagtctggtctcaaggccggatggggaggaagatgttttgtaatctttttttccccatgtgctttagtgggctttggttttctttttgtgcgagtgtgtgtgagaatggctgtgtggtgagtgtgaactttgttctgtgatcatagaaagggtattttaggctgcaggggagggcagggctggggaccgaaggggacaagttcccctttcatcctttggtgctgagttttctgtaacccttggttgccagagataaagtgaaaagtgctttaggtgagatgactaaattatgcctccaagaaaaaaaaattaaagtgcttttctgggtcatctgtggtgtatgttgacatggaccgctgcccctccatcctgcccttgcccgtggctttggtgtttcagatcctactcacgggaggcagctgccgcggaggtgtgggcagctgagaggggtgggcaggccagcacagctcctggcaggagacacaggtccaggagcccgtgagcatttgtgagagcagagatggcaagcacgtgcgtggagaccaacgaagcgtgtccctggcacacagcaagggagagtttcgctcggtctctgcagtgcagtctcctggcgtaagtcttgaagatggacccaactccctgaagaaatggatcttgaaattgaacacaaacatcatgaacgtacagcctgggcattctgcagtgatttgtgagatgagcttgcatcgactgttcctctcagcagtgacagccaaagtcacccctgataaaatgcagtttcactttataaaatgcctcgccccttcccagcatgtagagcttgtctgcagccctaaaggagccaggtcctgctctgatgagggtcaaatcagagccgacatcccatgtacaaaaaacccccaggcttctgccttccttccgggctcctgtctgctcccattttactccacggaatagttctgccctgtagcatctccagcggcctttgcagactgctgtcagccaacaggtgccaaaaatgcaaaagaagaagaaactaaaagcagtgctatttttgcagaacaaatgctagctattaaatcatcttaggccaagacaccaatggcacttggaccgataggtatttggagcatgagttaggaaggatatgtctttctccaggtgcgcagctgaaagttgctgagaaaagctgcctgtgttgctgtggtaacatgagaaggaatgaacagctctatacaaaaactggccacacattataaggcctattctatgcagttatgtttttggctatttgctcatttagtcattgtttatcaaccaaactaggtaagccaaggagttacaagacagctctagagaagctccctctgcttacaggacaataatgcattgtttgtttgttgatacaaatgaattatttgaatccacagaagtgaaaaagggaaaaaatcctggctgacttgtgggaagagcgtactgcagagcctagggcctgagttaactcgctggcggccctgcaggcaggcttgatgggagcgcccagcacatctgcccaccctgcacagggcatgaagcaccgtgtgcagagatctgtgggcaaaagcccaggacgtgaccttaggcaagaggggtccttggagaagtggaggtgtgcatggtgtgtagccttgcgtgtctgtgagcacgccctagtggacctgcgcctggattatcgggccagtctctcggaggggtccgtgatgctgagttacgccattcacctgaactctgcagctcatcggctgtaggatttgggtgagacacttttccttgctgactcatttccccatctgcaaaatgggggtgacgatatctacctcttggggtgtgtcaagggtaaaagagcacactttaagaatcctaaagcactaagccaaggatgaaagactagaaagctgcctctatgttgctactctcaaaaatgctcagaaattttcttgtcgtactaaaaatgtgttatttttctcattttcattcttccattcaacacagaagtaatctaagtaagttctaaaaacatagatccgggggcccacagacattcaattttcttctgaattggctctggtatcacacaacacacaagcaagcaaacagcctgcctgctagggccttgggttccaggctggaggaatgcaggcagaaatctcttaggaaataactaagtgagcgccaagttttgaattgccttagagccgaaagagaatgtggcgtgctggggagagatctggacctctttctcatcagtcatttgacctgtccacgaagaacaattttgttatgcagcctgggaacctggtttccttacaccctgcgcccttaatgacacagacaaccacgggtactcctggacggaagctcatcacgcctcctcaaataccttcacccatgttcaggtcacacggaggtcaccatctcctcagcacacaacaactgctttggttcccagggttattttttctacgagttgaaaacccacggagcctaagccatctttttgtcccctaaggagagccccatagactaagagctacacttcctgtctgtctttcccacctttccatctcattctagcttaaagcttatcacgctactgagagcctgttctgtagttcaaggtggcagagaaaaatacgaaccttgagtgaaatctggagagcagtgcagggtcatccccagacgtgacgggccatatcctaggcgactcctgcagcttatagaagcagggaatttaatggacttcttccaggaaagccagcccacggggactcttaaaaagacaccaaccatttggaagatgcagcttgaggtctgggggactggactgattctgccaccatatagtgaacacgattaatcgggaggaagaagtaaggcactctgtgagttagtctaccaccctattgactttgacagagagaaaaccaacttttttcatatgatcacacagtagtactggaatatctcgactgcaatatcctctaaacaaatgcatgcaaagctttgtaaaagcagctgatgattaaaaaaattttaaaacattagggtttttctaatatatccatatgtgggacagtgatttaaatgtcattaattgtccagccacaacttgtaacagtgatgtgaaagacacaaaaaaggccccactggagtggaggagtggtctggctggtccccaagcaaaacagaatgggcttcgcataggctttagaacttattcataaatattgaccaaagtgtgaagcaaggtatccagtgaagattctctagggtctctacttctgctcaagagatttaatccagctttctctaaagcagtggtccagacttgccacatactaggttaaagataaagtgagaaaaacaaatactttggtttgcacgtctcttgaggggccctaggctgtatggaggaatatttagaggaatatttgtgagctgccatttgtgtttaaaagaacatgaaagcaagacgggccctaacccgcctgtgtctgtagctgaccaggaggccactgcttccttcccccagagcttctaggagagccccccaaaatgcaactctccaaggtcctgtggagtagtcccctcataatgcctccaccacacctgtgtctcacgatgccttaactgacgtagctcctaagtgatgttcacagagaaggaaatacttaggcaagcccatgtgtaacatgctcacagatgtgctggctttgccaatgctttcggactccaccatgctttctgattcttctggtcctagtcacgccttggcacggggcagaagcggccgagctatgctgacaggtgctgctgagagccaacagccattcagccgagaaggcgtttctaggtgagggcatgagagctggcattccaggctgctgagtgcggcatctgcaggtgcaccacattgctccacggtgtgttcagaagagaccagcatcttgaatctcaggctctgggctcattctttgcctctgccaagggaccattcaggggcttcaagccagctgctgaaaatcccccttttctggatttttccccatctatataaggatatggtggctgtgtggacaagaaattggtttcatctcagaagggtgcttccctacaaagatcttcagaaatttaattgaaaacaattttttgaactttttttgtttggccaggatgaatgaagctgaagtcacatcctgaatgtgcatgccagacaaagggtaagcaagcagtctttacaaatgccaatccctctgcactccaaaaccggagcccgtaatgaaggcccaggttccagtcatcacaggatcccccaagccagcacagtgcctgatgcctccctaggcattagcacatcccagcactctaattcacatcctcagcatccctgcctcctgcatccagggcttaggttgagtgtttccagagtgtcaagtacatttaaacacaaaccaaatactccagggttttgacctgtcacaatggcttttgaaaacaacagacgtacaatttgagagaaggactcgatggacttcttaggctgaggactaaggacatgttgctgttcctcttggtccaggacattcaataccattcacagcattcatcaccaactgacatagtatcgatcacgacattcaactgtttgaaattactgctattttggtcaaaaactaagaaatcagaaattgcacctacatagtgtgtctcctcattggagtcccatctctctgagcacagggatgggctcctgagctcacagccctgccctgcccccccagcagggcctcaccctcatggccctcagtgaatagtgactacatgaagggggcacttactagaggcctgagtaatggaatttcaattagcttctgcttcccttttctaaaaaagaaccacctttcttaagaataattaggccaaaataaacttgagtaatttgtacagtcaatattttgaagtttcggagttaccagtgaaatagcaaagctgttctccaggaaaggacatccaggttcccacccaggccttccttcctcagctcctgcagcctcatcctagtttaatatgaaggttgtgaatgggttaaaaagcagttcttaagcacctacttagatcttttcagtatctggaaatagcacccagggctgtgttagtaaagcttttcactgggtaagagtcatacaatttttacatttaatttgtttttttaaaacaaggcagtcttgttttacatattggaatgactagatattttttgacatttctggcacctctggttctgctgaattttaagggaggtgagtggtatgtacacaaagttaagattgctgcataataattcctttgcatttccaaaataaattacacaaatgtcacttttccttttctattccatagtactagttttagccagatctttgccaaacattctaggacattcagaaaagtcatccatggaattttggaatgccattctctctgtatctttgcagatcatgaggaaggaaagttgatgaactagtacgggatggctcagacttgtaaagtgtctaagtcacaacgctgcagagccagcttccgggtagcaatggcatggcctcagctgtgccaaggctacaactggagcttccttactcgcatctgaggcaaacacagcaaggctggcccaggccgcccacagtcaacagatgttcacgggagatggatcagcccctcttttgcttgttctatcaaggaaagagatctaaccatgggcaagggtggaacacacccggttcaggtcagggaatgagttgctctaagtgaacagtgaattcttacttctcagcctgtatcaattgtacccagggttcatgattactgtgacccactaagggatgatctttgaggaaacagacctggagggaggtaatttaaggagggaaagcgagtgggttttacagactgctttgtggcgacattcaggaacagaccattcaatggatgacttttcagtacataaaagcaagcagtaatggccaggagagagcaaagatgccctaagaatgacatcagactgaccaaatgtgccttttcaaataagttatgagaacgaatgaattggaattagagcaaggtattggacagaaccatgctagtctttgagagaacgtgtggattgggtggatgtttggaccgaatgaatggtaactttttaatgtgaaacagagaactgatatatgggctgtcatgtcaccctagggtactgtcgctctgtcatgtgtagcaatctttccaaatttttgttggtgggctgaacaaagataaaactaataaagtatgtgtggataccactagacagcacagcttactggactggatgtaataaaactgactgaaacttt

SEQ ID NO: 803 - DNA, 7323 bp, Homo sapiens
  ENST00000379370
cccgtccccggcgcggcccgcgcgctcctccgccgcctctcgcctgcgccatggccggccggtcccacccgggcccgctgcggccgctgctgccgctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcacgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggattttcggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccactctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggacgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgccgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccccatttgagctgctccttcctgtgtgtgctctgggccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacgtgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaa

SEQ ID NO: 804 - DNA, 707 bp, Homo sapiens
  ENST00000477585
tgcccgctcctatcgccgcttccgcctctgccggggacggggacagcagaccctcggcgcccggcccccgcgcacctgccgcgcgcaccgcctctccggcctgcgcggctccgggggctccgggaagaccgagcgctggcggccagcccggggaggctgtgggcagcaggggtggctgcgggctcccagtccctcctccgcctacctcggagcccacatttgggatttctactccgggagaattctgccctcctcccacgatgagcctggaggactggagccgggacctggcacccccagggctgtgactgggtgaactctgagggcacagctgctgtccgccgccccaggggtcccaggatggggcgagcagccctgaagaggcccaagggcaccccgtgaggagcccccacgctctgagagtggggcgcagagccggagccccgggccatgcctccgctgccgctggcgcgggacacccggcagccgcctggcgcctccctgctggtgcgaggcttcatggtgccctgcaacgcctgcctgatcctgctggccaccgccacgctcggcttcgcggtgctgctgttcctcaacaactataaacccgggacccacttcactccagtgcctccgacgcctcctgatgcgtgccggggaatgctgtgcggcttcggcgccgtgtgcgagcccaacgcggaggggccggg

SEQ ID NO: 805 - DNA, 899 bp, Homo sapiens
  ENST00000469403
ctctcagtgggcctggccctcacccaaagctgcagaaacactttctgcgggagctggggagggaggggcagccggctacactgagagccggcagttgggggtagggcaggacctgcggtggactcttccagggaagggggtcctgcctgcacccctgtggctggggccccatctgacaggggtcaggccatgactatttggctggaggggcagagaaaagcaggggcctctgtctcagacctcagccagcccatggggtcagggctggacccttcagcagcctggatccctggggctagcggtgggggggggggggtgggcaggggtgcccctttccaggctgggcaaagggatgggacagggaggagcctgctcagaggagcctaacttggggatttgttttcttccagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtg

SEQ ID NO: 806 - DNA, 584 bp, Homo sapiens
  ENST00000479707
ctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccagggtgaggcctgacggccactgccccagaactgaccaggaaggcctgacgctgccctaaatccagccccacccgccctgagccacc

SEQ ID NO: 807 - DNA, 459 bp, Homo sapiens
  ENST00000466223
ctcatgaccatctgactaacatccaccttcccttgcacccttgtggcttgctgctggggcctgtgcctgggccagcctggatgccaggcagatgccaggcagggcctcactgtacctcccccacagccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggattttcggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgc

SEQ ID NO: 808 - DNA, 276 bp, Homo sapiens
  ENST00000478677
ccacctacccactggccttcctccccagatacccagagcagcaccagggcagcccggcttgggcggccccccaagtccttgcctactccctgccacagctggacgacctcttccggaattcagacgtcaagaaggattttcggagtgtccgcttgcgggacctggggcccggcaaatccgtccgcgccattgtggatgtgcactttgaccccaccacagccttcagggcacccgacgtggcccgggccctgctccggcagatccaggtgtccaggc

SEQ ID NO: 809 - DNA, 690 bp, Homo sapiens
  ENST00000492947
gggaggccgaggcaggcggatcacctgaggtcgggagttcgagaccagcctgaccaacatggagacactctgtctctactaaaaatacaaaattagccgggcgtggtggtgggcgcctgtaatcccacctcgtgaggctgaggcaggagaatcgcttgaacctggcaggcggaggttgcggtgagccaggatcgcgccactgcactccagccggggcaaaaagagcaaaactccgtctcaaaaaaaaaaaaaaaaaaaaaagcagggggcggtttcagggataaaagtggggaatcctcggagcttttccagccggccctcccggtcgccctttgcagtgcttggcgcccctgtgccggccttcgagggccgctccttcctggccttccccactctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacgg

SEQ ID NO: 810 - DNA, 861 bp, Homo sapiens
  ENST00000419249
caagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccgaaatcccgcaaggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgaactggccaatgagatccccgtccccgaaactctggattccggggcccttcacagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaa

SEQ ID NO: 811 - DNA, 3385 bp, Homo sapiens
  ENST00000461111
ttccaagcgaactggccaatgagatccccgtgtgagtagagctcggcgccccccgctccctctcactcccactcctccatccttcctggtggggagcagagtccggagcccccggggaactttccatcccttgtggcggaggatgggggtccggcgctatttggctgcaagaggccgtttcctgcctcagaagtgcagtcgcccctcccagggcacaggccgagggtcgccccacagccaacccccaccactgaggctgtacacacctgtgcgcatatgcatgcatgtctgtgtccgtgtgcacttccgcgtgtgtgaacatgcagctgtgtctgtgcgtgtctatgtatatggagtggatgtgcaagtgtgtgtgaatatccagctgtgtgtgtgcatgggtccatgtatatgtgtgtgtgtatatgtgggggggacatgtagatatgcgtgtgtgactatgcggccgtgtgtgtgcatggctccatgtatgtgtgtgtatatgagggagacatgcaggtatgtgtccgtgtgtgtgtgtgtgcatatgggtccatgtatgtgtgtgtatatgagggagacacgcaggtgtgtgtctgagtgtgtgcgcacatgggtccatgtatgtgtgtgtataggtgagggagacatgcatgtgtgtgtccgtgtgtgtgcatgggtccatgtgtgtatagtgtgtacacatgggtccatgtatgtgtgtgtatatgagggagacacgcaggtgtgtgtccgagtgtgtgtgcatgggtccatgtgtgtatagtgtgtgcacatgggtccatgtatgtgtgtgtatatgagggagacacgcaggtgtgtgtccgagtgtgtgtccatgggtccatgtatgtgtgtgtatatgtgggggagacaggtgtgtgtccgagtgtgtgcatgggtccgtgtatatgcgtgtatatatggggggatatgtagatgtgtgtgtgtatgaacaggtgtaagtggggagcactcaggtgtgtctgtgtgtgttcgtgtacacgtgtgtatgtgtgtgaacatggaggggtgtgtgtgtccgtgtgtaggtttgcgtgcatgcacacatgcatgtgtgtactggggcatccaagcccctggtctccactccataccaccctacgcctacctccttgatctctgcgcccagccttggctgtgctcccctgctgtctgcacgtgggtgtctgcacgtgggtgtctgcatgtgggtgtctgtgccctcaagtgtctcgtgtctgcacgtgggtgtctgcaccctcacgtgtctcgtgtccgcacaagcatgtgtaggtgtccctgctgggctctttggtgggcggccagtgatcctcgaggtcacgcatgtcttctgtgggtgcctgctccttgcaccccacagtgttgagatgggtttgcattggccccgcctgtcccctgctcacccgcctccctctcttcctgcttctaagccccgaaactctggattccggggcccttcacaggtgagcacgtggcagcagtgcctgcagacccctggctggcccatctgtcctcccgcccgtctctctgatctctctctgccaggctgcccctgtctccatccctcttctccctcccactgtcggtgtctgcccaccagccacccctgggtcccgtcacagcccttgtggcctccgcagctggggcccttgtcctcccgcctcccccaccctgtcctgttgccaccttcctagaggccctgacctgccctctgccctccagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggacgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgccgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccccatttgagctgctccttcctgtgtgtgctctgggccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacgtgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaacttt

SEQ ID NO: 812 - DNA, 7394 bp, Homo sapiens
  ENST00000620552
cccgtccccggcgcggcccgcgcgctcctccgccgcctctcgcctgcgccatggccggccggtcccacccgggcccgctgcggccgctgctgccgctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcacgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggattttcggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccactctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccgaaatcccgcaaggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgaactggccaatgagatccccgtccccgaaactctggattccggggcccttcacagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggacgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgccgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccccatttgagctgctccttcctgtgtgtgctctgggccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacgtgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagc

SEQ ID NO: 813 - DNA, 2291 bp, Homo sapiens
  ENST00000366667
aagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccgggggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgatgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactatctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgccttcggtttgtatttagtgtcttgaatgtaagaacatgacctccgtgtagtgtctgtaataccttagttttttccacagatgcttgtgatttttgaacaatacgtgaaagatgcaagcacctgaatttctgtttgaatgcggaaccatagctggttatttctcccttgtgttagtaataaacgtcttgccacaataagcctccaaaaa

SEQ ID NO: 814 - DNA, 701 bp, Homo sapiens
  ENST00000530124
tcattccagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctggactgtagaagcggccaggaagaaaaccaccccctcttaaggttgtttttgtgaccgttctttggagcattgttctaaaaatgggaaattacatattgctgtgccaagggcaacaaacacctgcagttaaaggaataccttccgcgaggcggcttttcggagcatgcatgtttatagctccagccaggccagaccgagggctgctgcataagccctgcttggtgcatttctttacttgcaaggggacagagtgtgggcttaggtttgggactagagggggctttggcaactatggtgctcaggtgattatccttcgctcgtttatccaataaacatttatcaagcatctg

SEQ ID NO: 815 - DNA, 1024 bp, Homo sapiens
  ENST00000257247
agctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgaacacaccacagccatcagcactggaatgcaaagaccagaacaaacagaaggaagccagcagccaagccggggcagtttcagtctccaccccaaatgcaggactgtagaagcggccaggaagaaaaccaccccctcttaaggttgtttttgtgaccgttctttggagcattgttctaaaaatgggaaattacatattgctgtgccaagggcaacaaacacctgcagttaaaggaataccttccgcgaggcggcttttcggagcatgcatgtttatagctccagccaggccagaccgagggctgctgcataagccctgcttggtgcatttctttacttgcaaggggacagagtgtgggcttaggtttgggactagagggggctttggcaactatggtgctcaggtgattatccttcgctcgtttatccaataaacatttatcaagca

SEQ ID NO: 816 - DNA, 793 bp, Homo sapiens
  ENST00000525875
cagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaagaacacaccacagccatcagcactggaatgcaaagaccagaacaaacagaaggaagccagcagccaagccggggcagtttcagtctccaccccaaatgcaggactgtagaagcggccaggaagaaaaccaccccctcttaaggttgtttttgtgaccgttctttggagcattgttctaaaaatgggaaattacatattgctgtgccaagggcaacaaacacctgcagttaaaggaataccttccgcgaggcggcttttcggagcatgcatgtttatagctccagccaggccagaccgagggctgctgcataagccctgcttggtgcatttctttacttgcaaggggacagagtgtgggcttaggtttgggactagagggggctttggcaactatggtgctcaggtgattatccttcgctcgtttatccaataaacatttatcaagc

SEQ ID NO: 817 - DNA, 584 bp, Homo sapiens
  ENST00000533365
gggcttggcgtgggaggagggctaagctgcgctcgctggaaccctgcgctccagcggtgcgcgccaggagagggggcccgaagcgaggtctcgcctagagttggaaaggcagcgtgcttagggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgaacacaccacagccatcagca

SEQ ID NO: 818 - DNA, 18787 bp, Homo sapiens
  ENST00000378024
acaagagccgcctccgcgcacgggggcccggccactcggagctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgagcggggatgatgaggagtaccagcgcatctacaccacgaagatcaagccacggctgaagtcggaagatggagtggaaggagacctcggggagacccagagccgtaccatcacagtgaccagaagggtcacggcctacactgtggatgtgactggccgggaaggagccaaggacatagacatcagtagccctgaattcaagatcaagattccaagacatgaactgactgaaatctccaatgtggatgtggagacccagtctgggaagaccgtgatcagactgccctcgggctcgggggcagcctctccgacaggctctgctgtggatatccgagcaggggccatttctgcttcaggaccagagctccaaggtgctggccactcgaagctccaggtcaccatgcctgggataaaggtgggaggctcaggtgtcaatgtcaatgcaaagggcttggacttgggtggcagaggaggggtccaagttccagcagtggacatttcatcttctcttgggggtagggcagtagaggtacagggcccatctctggagagtggtgatcatggcaaaattaaatttcccaccatgaaagtgccgaaatttggtgtctcaacagggcgtgagggccagacaccaaaggcagggctgagggtttctgcacctgaagtctctgtggggcacaagggcggcaagccaggcttgactatccaagcccctcagctggaagtcagtgtgccctctgccaatattgagggccttgaggggaagctgaagggcccccaaatcactgggccatcacttgagggtgacctaggcctgaaaggtgccaagccacaggggcacattggggtggatgcctctgctccccaaattgggggtagcatcactggccccagtgtggaagttcaggcccctgacattgatgttcaggggcctgggagcaaactgaatgtgcccaagatgaaagtccccaagttctctgtatcaggtgcaaagggagaggaaactgggattgatgtgacactgcctacaggtgaagtgactgttcctggggtctctggggatgtcagcctgcctgagattgctactggtgggctggaaggaaagatgaaaggtactaaagtgaagactcctgaaatgattattcagaaacctaaaatctccatgcaggatgtggatctgagccttgggtctcctaaactgaaaggagatattaaggtttctgctcctggggtgcaaggtgatgttaaaggccctcaagtggcacttaaaggctccagagtggacatagagacaccaaacctagagggaaccttgacaggccctaggcttggcagtccttccgggaaaaccggaacctgtaggatctctatgtcagaagtagacttaaatgtggccgcacctaaagtgaaagggggtgtagatgtcacactccccagagtagaagggaaagtcaaagtccctgaagttgatgtcagaggccccaaagtggatgtcagtgccccagatgtcgaagcgcatggcccagaatggaacctgaaaatgcccaagatgaaaatgcccacgttcagcactccaggagccaaaggggaaggtccagatgttcatatgactctacccaaaggagatatcagtatttcagggcccaaggtcaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgccagggttcaaagcagagggcccagaagtggatgtgaacctgcccaaggctgatgtggacatttccgggcccaagatagatgttactgctcctgatgtgagcattgaggaaccagaagggaaattgaaagggcccaagtttaagatgcctgagatgaacatcaaagtccccaagatctccatgcctgatgtggacttacatctgaaaggccctaacgtaaagggagaatatgatgtcacaatgccaaaggttgaaagtgagattaaagttcctgatgttgaacttaaaagtgccaaaatggacattgatgtcccagatgtggaggttcaaggcccagactggcacctgaagatgcccaagatgaaaatgcccaagttcagcatgcctggcttcaaagcagagggcccagaagtggatgtgaacctgcccaaggctgatgtggacatctcaggacccaaggtgggtgttgaagttccagatgtgaatattgaaggacctgaaggaaagctgaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtggacatttctgcaccaaaagtagatactaatgctccagatctgagccttgaaggacctgaagggaagttgaaaggcccgaagtttaagatgcctgagatgcacttcagagctcctaagatgtctttgccagatgttgacctggatcttaaaggacccaaaatgaaaggaaatgtagatatctctgcaccaaagatagagggtgaaatgcaggttccagatgtggacatcagaggtcccaaggtagatattaaagcaccagatgtggaaggccaaggcctggactggagcctgaaaatacccaagatgaaaatgcccaagttcagcatgcccagcctcaaaggcgagggcccagaagtggatgtgaacttgcctaaggctgacgttgttgtctcaggacccaaggtggacatcgaagccccagatgtgagcctcgaaggtccagaagggaagctgaagggtcccaagtttaagatgcctgagatgcatttcaagacccccaagatctccatgcctgatgtggacttacacttgaaaggccccaaagtcaaaggggatgtggatgtgtctgtgcccaaggtagaaggtgaaatgaaagtgccagatgttgaaatcaaaggacccaaaatggacattgatgccccagatgtggaggttcaaggcccagactggcacctgaagatgcccaagatgaaaatgcccaagtttagcatgcctggcttcaaaggagagggccgagaagtggatgtgaacctgcccaaggctgacattgatgtctcaggacccaaggtggatgttgaagtcccagatgtgagccttgagggcccggaaggaaagctgaagggccccaagtttaagatgcctgagatgcacttcaaggcccccaagatctccatgcctgatgtggacctgaatcttaaggggccaaaattgaagggagatgtggatgtgtccttgcctgaggtagaaggtgaaatgaaagtgccagatgttgacattaaagggcccaaagttgacattagtgctccagatgtggatgttcatggcccagattggcacctgaagatgcccaaggtgaaaatgcccaagttcagcatgcccggcttcaaaggagagggccctgaagtggatgtgaagctgcccaaagctgacgttgatgtctcaggacccaaaatggatgctgaagttccagatgtgaatattgaaggtccagacgcaaaactaaaaggtcccaaattcaagatgccagaaatgagtataaagcctcagaagatatccataccagatgttggtttgcatttgaaaggtcctaaaatgaaaggagattatgatgtaacagttccaaaagtagaaggagagataaaagctcctgatgttgacatcaaaggccccaaagttgatattaatgcaccagatgtggaggttcatggcccagactggcacctgaagatgcccaaggtaaaaatgcccaagttcagcatgcctggctttaaaggagagggcccagaggtggatatgaacctgcccaaggctgaccttggtgtttcaggacccaaggtggacattgatgttccagatgtgaatcttgaagctccagaggggaaactaaaaggccctaagttcaagatgccaagcatgaatatacagacgcacaaaatctctatgcctgatgttggacttaatttgaaagcccctaaactgaaaactgatgtagatgtttcccttcccaaagtggaaggagacttgaagggtcctgaaattgatgtgaaagcccctaagatggatgtgaatgttggtgatattgatattgaaggtccagaagggaagttgaagggccccaagtttaagatgcctgagatgcatttcaaggcccccaagatctccatgcccgatgtggacttacacttgaaaggccccaaagtcaaaggggatatggatgtgtctgtgcccaaggtagaaggtgaaatgaaagtgccagatgttgacattaaagggcccaaagtggacattgatgccccagatgtggaggttcacgacccagattggcacctgaaaatgcccaagatgaaaatgcccaagttcagtatgcctggcttcaaagcagagggccctgaagtggatgtgaatctgccaaaggctgacattgatgtgtctggacccagtgtggacactgatgctcctgatttggatattgagggaccagaaggaaagttgaaaggctccaaatttaagatgcccaagttgaatataaaagctcccaaggtctccatgccagatgtggacttgaatttgaagggacccaaactgaagggagagatagatgcttctgtgccagaactggaaggtgatctcagagggccgcaagttgatgtcaaaggtccttttgtggaagcggaggtgcccgatgttgatctggagtgtcctgatgcaaagttgaaagggcccaagtttaagatgcctgagatgcacttcaaggcccccaagatctccatgcctgatgtggacttacacctgaaaggccccaaagtcaaaggggatgcggatgtgtcggtgccaaaattggagggagatttaacaggccccagtgtgggtgtggaggtgcctgatgttgagctggagtgtcctgatgcaaagttgaaaggccctaaatttaagatgccagacatgcacttcaaggcccccaagatctccatgcctgatgtggacttacacttgaaaggccccaaagtcaaaggggatgtggatgtgtcggtgccaaaattggagggagatttaacaggtcccagtgtgggtgtggaggtgcctgatgttgagctggagtgtcctgatgcaaagttgaaagggcccaagtttaagatgcctgagatgcacttcaagacccccaagatctccatgcctgatgtggacttacacctgaaaggccccaaagtcaaaggggatatggatgtgtctgtgcccaaggtagaaggtgaaatgaaagtgccagatgttgacatcaaaggacccaaaatggacattgatgccccagatgtggatgttcatggcccagactggcacctgaagatgcccaagatgaaaatgcccaagttcagcatgcctggcttcaaagcagagggcccagaagtggatgtgaacttgcccaaggctgatgttgttgtctcaggacccaaggtggatgttgaagtcccagatgtgagccttgaaggtccagaagggaagctgaagggccccaagcttaagatgcctgagatgcacttcaaggcccccaagatctccatgcctgatgtggacttacacttgaaaggccccaaagtcaaaggggatgtggatgtgtctttgccaaaattggagggagatttaacaggccccagtgtggatgtggaggtgcctgatgttgagctggagtgtcctgatgcaaagttgaaagggcccaagtttaagatgcctgagatgcacttcaagacccccaagatctccatgcctgatgtgaacttaaacttgaaaggccccaaagtcaaaggggatatggatgtgtctgttcccaaggtagaaggtgaaatgaaagtgccagatgttgacatcagagggcccaaagtggacattgatgccccagatgtggatgttcatggcccagactggcacctgaagatgcctaagatgaaaatgcccaagttcagcatgcctggcttcaaaggagagggcccagaagtggatgtgaacttgcccaaggctgacgttgatgtctcaggacccaaggtggatgttgaagtcccagatgtgagccttgaaggtccagaagggaagctgaagggccccaagtttaagatgcctgagatgcacttcaagacccccaagatctccatgcctgatgttgatttcaatttaaagggacccaaaatcaaaggagatgttgatgtttctgccccaaagctggagggagagttaaaaggtccagaattggatgtcaaaggtcccaaattagatgctgacatgccagaagtagctgtggaaggcccaaatggcaagtggaaaactcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtcagtgggccagacattgacattgagggaccagagggcaaattgaaaggccctaagttcaagatgcctgatatgcatttcaaagcccccaatatttctatgcctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgacatctcaggacccaaggtggacattgaaggccctgatgttaatattgaaggaccagagggaaagttgaaagggcctaagttaaagatgccagagatgaacatcaaagcccccaagatctccatgcctgactttgatttgcatctgaaaggtcccaaggtgaagggcgatgtggatgtttctctgcccaaagtggaaggtgacctcaagggccccgaagttgacatcaaggggcccaaagtggatattaatgccccagatgtgggtgttcaaggcccagactggcacctgaagatgcccaaggtgaaaatgccaaagttcagcatgcctggcttcaaaggagagggcccagatggggatgtgaagctgcccaaggctgacattgatgtctcaggacccaaagtggacattgaaggccctgatgttaacattgaaggaccagagggaaagttgaaagggcctaagttcaagatgccagagatgaatatcaaagcccccaagatctccatgcctgatattgacttaaacctgaaaggacccaaagtgaagggtgatgtggatgtttcccttcctaaagtggaaggtgacctcaagggcccagaagttgacatcaagggcccaaaagtggacattgacgcacctgatgttgatgttcatggcccagactggcacctaaagatgcccaagataaaaatgcccaagatcagcatgcctggcttcaaaggagaaggtccagatgtggacgtgaacctgcccaaggctgacattgatgtctcaggaccgaaagtggatgttgaatgtcccgatgtgaatatcgaaggacctgaaggaaagtggaaaagtccaaagtttaagatgccagagatgcattttaagactccaaagatatccatgccagatattgacctgaatctcacaggtccaaaaataaaaggagatgtggatgttacaggccctaaggtagagggagatctgaaaggtcctgaagttgacctcaaaggccccaaagtggacattgatgtcccagatgttaatgttcagggtccagactggcacctgaagatgcccaagatgaaaatgcccaagttcagcatgcctggcttcaaagcagagggccctgaagtggatgtgaacctgcccaaggctgacgttgatgtctcaggccccaaagtggacgttgaaggccctgatgttaacattgaaggaccagagggaaagttgaaagggcccaagttcaagatgccagagatgaatatcaaagcccccaagatccccatgcctgactttgatttgcatctgaaaggtcccaaggtgaagggcgatgtggatatttctctgcccaaagtggaaggtgacctcaagggccctgaagttgacatcaggggtccccaagtggacattgatgtcccggatgtgggcgttcaaggcccagactggcacctaaaaatgcccaaagtgaaaatgcccaaattcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaaaatgcctgagatgaacatcaaagcccccaagatctccatgcctgacattgatcttaacctgaaaggtcccaaagtgaagggtgacatggatgtgtctctgccaaaagtggaaggtgacatgaaagttcctgacgtggatattaaaggccccaaagtggatattaatgccccagatgtggatgttcaaggcccagactggcacctgaagatgcctaaaataaaaatgcccaagatcagcatgcctggcttcaaaggagaaggtccagaagtggacgtgaacctgcccaaggctgaccttgacgtctcaggacccaaggtggacgttgatgttccagatgtgaatattgaaggtccagatgcgaaactgaagggccctaaattcaagatgccagagatgaacatcaaagctcctaaaatatcaatgcctgatttggacctcaatcttaaaggccctaaaatgaaaggagaggtggatgtttcacttgcaaatgtagaaggtgatttgaaaggacctgctcttgacataaaaggcccaaagatagatgtagatgctccagatattgacattcatggcccagatgccaaattaaaaggtccaaaactgaagatgcctgacatgcatgtaaacatgcccaagatctccatgccagaaattgacttgaatttgaaaggctcaaagcttaagggagatgttgatgtctctgggcccaagttggaaggtgacattaaagctcccagtttggatataaagggcccagaagtggacgtttccggtcctaagcttaatatcgaaggcaagtcaaagaaatctcgttttaagcttcccaaatttaatttttcgggctctaaagttcagacacctgaagtggatgtcaaaggtaaaaagccagatattgacataacaggtccaaaagttgatattaatgctcctgatgtcgaggtccaaggaaaagtgaaaggatccaagtttaaaatgcctttcctgagtatttcatctcccaaagtttctatgcctgacgtggagctaaatttgaaaagtcccaaagtcaaaggagacttagatattgcaggtcccaatttagaaggtgactttaaaggccccaaagtggatattaaggcaccagaagtcaatcttaatgcacctgatgtggatgttcatggtccagactggaatctgaaaatgcccaagatgaaaatgcccaaattcagtgtgtctggcttaaaagcagaagggccagatgtagctgtggatctaccaaaaggagacatcaacatagagggcccaagtatgaacattgagggcccagatctcaatgtggaaggtccggagggaggcttgaaaggtcccaaattcaagatgcctgacatgaatatcaaagctcccaagatctccatgcctgacattgacttaaacttgaaaggccccaaggtgaaaggtgatgtggatatttctcttcccaaacttgaaggggatctgaaagggccagaggttgatatcaaaggccctaaagtggacatcaatgccccagatgtggatgttcatggtccagactggcatctgaagatgcccaaagtgaaaatgcccaagttcagcatgcctggcttcaaaggagaaggccctgaagtcgatgttaccctccctaaagctgacattgacatttctggtcccaatgtagacgttgatgttccagacgtgaatattgaaggtccagatgcaaagctgaagggccccaagttcaagatgcctgagatgaacatcaaagcccccaagatctccatgcctgactttgacctgaacttgaagggacccaaaatgaagggtgatgtggttgtgtctttgcccaaagtggaaggtgatctaaaaggccctgaggtggacatcaagggccccaaagtggacattgacactcctgacattaacatcgaaggctcagagggtaaattcaagggacccaaatttaagataccagagatgcacctgaaggctcccaaaatatcgatgcctgacattgatttaaacctgaagggccccaaagtcaagggcgatgtggatgtttctctgcccaaaatggaaggtgacctcaagggtcctgaagttgacatcaagggccccaaagtggacattaatgctccagatgttgatgttcaaggcccagactggcacctgaagatgcccaaggtgaaaatgcccaagttcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaagatgcctgagatgaacatcaaagcccccaagatctccatgcctgacattgatcttaacctgaaaggacccaaagtgaagggtgatatggatgtgtctctgccaaaagtggaaggtgacatgcaagttcctgacttggatattaaaggccccaaagtggatattaatgccccagatgtggatgttcgaggcccagactggcacctgaagatgcctaagataaaaatgcccaagatcagcatgcctggcttcaaaggagaaggtccagaagtggatgtgaacctgcccaaggctgaccttgacgtctcaggacccaaggtggacgttgatgttccagatgtgaatattgaaggtccagatgcgaaactgaagggccctaaattcaagatgccagagatgaacatcaaagcccccaagatctccatgcctgactttgatttgcatctgaaaggccctaaggtgaaaggagatgtggatgtttctctgcctaagatggaaggtgatctaaaggcccctgaagttgacatcaagggccccaaagtggacattgatgccccagatgtggatgttcatggcccagactggcacctgaagatgcccaaggtgaaaatgcccaaattcagcatgccaggatttaaaggagagggcccagaagtggatgttaatttgcccaaagctgacattgatgtctcaggacccaaagtggacattgacactcctgatattgatattcatggtccagaagggaaactgaagggccccaaatttaaaatgcctgacctgcacctcaaggcaccgaagatctctatgcctgaagttgacctgaatctgaaaggtccaaagatgaagggcgacgtggacgtttctctgcccaaagtggaaggcgacctcaagggccctgaagttgacatcaagggccccaaagtggacattgatgtcccagatgtggacgttcaaggcccagactggcacttaaaaatgcccaaagtgaaaatgcccaagttcagcatgcctggcttcaaaggagagggcccagatgtggatgtgaacctgcccaaggctgaccttgacgtctcaggacccaaggtggacattgatgttcctgatgtgaatatcgaaggtccagatgcgaaactaaagggccctaaattcaagatgcctgagatgaacatcaaagcccccaagatctccatgcctgactttgatttgcatctgaaaggtcccaaggtgaagggtgatgtggatgtttcccttcctaaagtggaaggtgacctcaagggcccagaagttgacatcaagggccccaaagtggacatcgatgcccctgatgtagatgttcatggcccagactggcacctgaagatgcccaaggtgaaaatgcccaaattcagcatgccaggattcaaaggagagggcccagatgtggatgttacccttcctaaggctgacattgagatttctggccccaaagtggacattgatgcccctgatgtcagtatcgaaggtccagatgcaaaactcaagggtccaaagttcaagatgccagagatgaacatcaaggcccccaaaatctccatgcctgacattgactttaacttgaagggtcccaaagtgaaaggtgatgtggatgtctctctgcccaaagtggaaggtgatctcaagggccctgaaattgacataaaaggccccagtttggacattgacacacctgatgtcaatattgaaggtccggaaggaaaattgaaggggcccaaatttaagatgcctgagatgaacatcaaagctcccaaaatctctatgcctgactttgatttgcacctgaaaggtcccaaggtgaagggtgatgtggatgtttcactacctaaggtggaaagtgatctgaaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcagggaccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaacct

SEQ ID NO: 819 - DNA, 580 bp, Homo sapiens
  ENST00000530285
gagctggcgacccgactccatggtccagcacatggcacagagactggggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgagcggggatgatgaggagtaccagcgcatctacaccacgaagatcaagccacggctgaagtcggaagatggagtggaaggagacctcgggg

SEQ ID NO: 820 - DNA, 568 bp, Homo sapiens
  ENST00000528508
agctgcgctcgctggaaccctgcgctccagcggtgcgcgccaggagagggggcccgaagcgaggtctcgcctagagttggaaaggcagcgtgcttagggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgagcggggatgatgaggagtaccagcgcat

SEQ ID NO: 821 - DNA, 579 bp, Homo sapiens
  ENST00000531324
aagagccgcctccgcgcacgggggcccggccactcggagctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagtggaaggacgtgagacgaattaccccacccccaacacctcacctggcagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagct

SEQ ID NO: 822 - DNA, 2173 bp, Homo sapiens
  ENST00000505113
ggcacgtggactccctttaatccagtgactgtcaggtcgatcatatgccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtcgtgcaggagcagagctcacggcagcctgcggccggcgccccctcgcccggagacagctgtcctcttgcagggtctgccgtgctggagggaaggctgctgttggagtctcttaatggctttgctctggtcgtgagtgcagaagggacgatattttatgcatcagcaacgatcgtggactatctgggcttccatcagacggatgtaatgcaccagaacatttatgactacatccacgtggacgaccgccaggacttctgccggcagctccactgggccatggaccctccccaggtggtgtttgggcagcccccgcccttggagacaggagatgatgctatcctggggaggctgctcagggcccaggagtggggcacaggcacgcccaccgagtactcggccttcctgacccgctgcttcatctgccgtgtgcgctgcctgctggacagcacctcgggcttcctgacgatgcagtttcaaggaaaactaaaattcctgtttggacagaagaagaaggcgccgtcaggagccatgctcccgccgcggctgtcgctgttctgcattgcggcacccgttctcctcccctccgcagcggagatgaaaatgaggagcgcgctcctgagggcaaaacccagagcagacaccgcagccaccgcggatgcaaaagtaaaagccaccaccagtctgtgcgaatcggaactgcatggaaaacccaattactcagcaggaaggagcagcagagagagcggcgttttggtgctcagggaacagactgacgctggccgatgggcacaggttcccgccagggccccatgcctgtgcctccggggtggccctgaccttgtccttgaccccaaggggggctcaggggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctc

SEQ ID NO: 823 - DNA, 5661 bp, Homo sapiens
  ENST00000316418
ggcacgtggactccctttaatccagtgactgtcaggtcgatcatatgccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtcgtgcaggagcagagctcacggcagcctgcggccggcgccccctcgcccggagacagctgtcctcttgcagggtctgccgtgctggagggaaggctgctgttggagtctcttaatggctttgctctggtcgtgagtgcagaagggacgatattttatgcatcagcaacgatcgtggactatctgggcttccatcagacggatgtaatgcaccagaacatttatgactacatccacgtggacgaccgccaggacttctgccggcagctccactgggccatggaccctccccaggtggtgtttgggcagcccccgcccttggagacaggagatgatgctatcctggggaggctgctcagggcccaggagtggggcacaggcacgcccaccgagtactcggccttcctgacccgctgcttcatctgccgtgtgcgctgcctgctggacagcacctcgggcttcctggcccgggggtcacaggcttggcagctgcggctctgctgtcccgagccactcatgacgatgcagtttcaaggaaaactaaaattcctgtttggacagaagaagaaggcgccgtcaggagccatgctcccgccgcggctgtcgctgttctgcattgcggcacccgttctcctcccctccgcagcggagatgaaaatgaggagcgcgctcctgagggcaaaacccagagcagacaccgcagccaccgcggatgcaaaagtaaaagccaccaccagtctgtgcgaatcggaactgcatggaaaacccaattactcagcaggaaggagcagcagagagagcggcgttttggtgctcagggaacagactgacgctggccgatgggcacaggttcccgccagggccccatgcctgtgcctccggggtggccctgaccttgtccttgaccccaaggggggctcaggggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctcagatctgtgtgtctacgctcagatgcgtcggtggctgggctgccctgctcctggtcaggccggagcccgtcctaagacacacgctttgcagagctgtgcatgcgcagtctgctagtgtgtgtgtgcagcatacgcaggagcctatcctgaattttgtaaaatatcccaacagttcttaaatgaaaactggccttaagtctattcaagcatgacagcatttctctttgaggaattaaaatctttaggaaagtgatcatggctggacagcttcatgccccagaggcagcgagcacccgtcccatggctgccaagtccacagtcggggatgaagcagtcgggtgatgctcccaagtccgcagtcggggatgaagcggtcgggtgatgctcccaagtccgcagtcggggatgaagcggtcgggtgacacacctagctcagccctcccaggccacctgcagctcccagcctgtgctgtgcaggcagggtcagcccatcgccacagtgcactgtagaggccagcacacggcaaattagaaatacaacacgcggagaaaggggtccgtgagcccactcatagaggaatctagaacgttccaggcagcagaggctggcagcgtgggtcccacactgccccacaccgtgcggcaggtgctccatggcgccatgacagagtctgaggccagacctggactggaattgacagcataacccctgttccttctggacatctcccgagttctcagtgggtctctgcggacggttcttcctaatctgcctcttggtacatcacgtaatacagagttcacagactccgggtttggaagtacagagaaacacacaacgtagagagaagacacaggaaactgcgctgcctgtgggggtttctctctggctggctgtacagttcactcaaatgagggttcccattgccatcctaggagaataattagggacaagacagacaagtattaatagcattaaaacagttgtaaaggcgatattttctgagagtaggaaatttggatacaaaagcataagtcagaaagtgaaggtcaccaatccaccaacccgagaacctacagctgatggtgcatttcaggcttcttccacggtctggcctggaaccccacccggctggtgcaggcatcagatcagggtgtagaagtcaccccaagcaagaggaagccaggcagtgaggccctggggtgtggctgcagctgggcccacctgtgcgggggtgggaaggccccatcctcagggagagggcatcggcgccctgacgtcagctccactgggagtggcaggagctgtgggagcccatgggtgagggacccaccaccccgctgcactgtgcattgtgcctcccgtgtggacgccctctctgttgttggcccgcgggtgagggacccaccacccctagggacccaccaccccgccgcactgtgcattctgcctcctgtgtggacgccctctctgttgtcagtggctttgaggtgtcagtgcttacttagatgctggtttaatgctggacccatttgttaaacgcaccttcactttgtcaaaacccaggtttggttggcaggactgggtcttctgcccaatgccaggtgcctgcgcctctcagtggcctggttcttggacagtttgcccccatgtggcagggatagggataaggatctcctctcagtactggaagagaacagccaaccatctgagcccagagtcacagatccatcgtggccccctatgacccccaagccctaccgagggggcactcactctctgcttagccagggggcgtctttcaaaaggtgacctccatgctgtgctgtcgtgggtgtgagacgtgctcatggccttccactgccatctctcccttatctgatgcctaaagtcacgatggggacagagctacccaggggccagccatggggtgaccagccacctgagggtcagtcacctgtggagagcaggcacctgtgaagaccaggcacctgaggactggcgcctacttcccactttggccctacactggcacagagcccctctttattcatttctcatgctgagcatggcacacttctggcctctgggcatttatggatttaagaccaggatggtatttcagaagcttcccacttccttcctattctaaccgagtgcccagctcctttgctgatcatggaaagacccttaataattaggcctgcaggccaggcgcagtggctcatgcctataatcccagcactttaggaggtcaaggtaggaggatcgcttaagcccaggagttcaagaccagcctgggcaacacaggaagaatgtgtctctacaaaaaataattaaaaatcagatctgctgtatccctgaaaaagtctcaatcaacatgcatgttccactcttggagttccctgttctgagggccagccacgtcctgtgtcctggagcttagccctcagcagctcccttcagcctgggcgccgcctgggtcccaaacgtggcagctgctcttccagtctcggggccgaggagggcagggagctcagtgactgagagtcttgtgtatcacatgtcttgagtgtcctggagccaacggctgtcactgggaaaaacaccaggccccaaagatcgaatcagagacgtggctgcgtgtttgcgattgtagccaggcccttcagtgtcatcaaaggagcactggggcctccttaagcacagacggcagcccctgcccaggaggcttcttcaccacgtcctgccctgcagcctcccagacctttagatgcgcccctgcccaaggccctcctggtgacaggtgccagattgagtggtgggttgctgccaggcaggccacgctgtgttgacgctgcactcagcacgtgggtgttggctctgccggttttgtggtgtggggaccctacaggaggctgcggccctgagagcctgggatcagcgaggtgtccgacatcccttcctcaacggcaacaaaaactccccaagtcagcactttggttattttatagccacaaccctcttggaaaacagtggggaagactatggaacatagaaagtgtggatgtatcacttctctctaaaatgtcattgttagcactaattacaggttcatgtttttctgtgtatgtagcttttccctatatagctgaaaaagtattaaagtcaaatataaggtgggaatgggatggaagggaggagatcaatacaacttatatttttgcagtttctactggaagaaaaaagttttcaatacctagaccaacttgttgaatttttaaaacttatgcactataaatgcaactttctctactgctttctcagtgcctttaggaagctttcaaatttttttgtactgtggtttgtattaaatttgcaatattgatgtaaaatacatgacatgctagtacatgtttaacaaaaatttaaa

SEQ ID NO: 824 - DNA, 1912 bp, Homo sapiens
  ENST00000512529
gactccctttaatccagtgactgtcaggtcgatcatatgccgaggacgatgatcccgccgggggagtgcacgtacgcgggccggaagcggaggaggcccctgcagaaacatctcttaatggctttgctctggtcgtgagtgcagaagggacgatattttatgcatcagcaacgatcgtggactatctgggcttccatcagacggatgtaatgcaccagaacatttatgactacatccacgtggacgaccgccaggacttctgccggcagctccactgggccatggaccctccccaggtggtgtttgggcagcccccgcccttggagacaggagatgatgctatcctggggaggctgctcagggcccaggagtggggcacaggcacgcccaccgagtactcggccttcctgacccgctgcttcatctgccgtgtgcgctgcctgctggacagcacctcgggcttcctgacgatgcagtttcaaggaaaactaaaattcctgtttggacagaagaagaaggcgccgtcaggagccatgctcccgccgcggctgtcgctgttctgcattgcggcacccgttctcctcccctccgcagcggagatgaaaatgaggagcgcgctcctgagggcaaaacccagagcagacaccgcagccaccgcggatgcaaaagtaaaagccaccaccagtctgtgcgaatcggaactgcatggaaaacccaattactcagcaggaaggagcagcagagagagcggcgttttggtgctcagggaacagactgacgctggccgatgggcacaggttcccgccagggccccatgcctgtgcctccggggtggccctgaccttgtccttgaccccaaggggggctcaggggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctcagatctgtgtgtctacgctcagatgcgtcggtggct

SEQ ID NO: 825 - DNA, 563 bp, Homo sapiens
  ENST00000514523
tcctggccagggcgcgctgccccgcgggtgtgcctgagcctccgcgccccgcaggccctgggccgaggacgatgatcccgccgggggagtgcacgtacgcgggccggaagcggaggaggcccctgcagaaacagtaaagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtcgtgcaggagcagagctcacggcagcctgcggccggcgccccctcgcccggagacagctgtcctcttgcagggtctgccgtgctggagggaaggctgctgttggagtctcttaatggctttgctctggtcgtgagtgcagaagggacgatattttatgcatcagcaacgatcgtggactatctgggcttccatcagacggatgtaatgcaccagaacatttatgactacatccacgtggacg

SEQ ID NO: 826 - DNA, 576 bp, Homo sapiens
  ENST00000510400
gtgtgcgcgcgttctccaaacgccacccccacggggcctcacagccgccccggcctggcaaccgtcacccattttacgaacgaggacatcaaggccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtcgtgcaggagcagagctcacggcagcctgcggccggcgccccctcgcccggagacagctgtcctcttgcagggtctgccgtgctggagggaaggctgctgttggagtctcttaatggctttgctctggtcgtgagtgcagaagggacgatattttatgcatcagcaacgatcgtggactatctgggcttccatcagacggatgtaatgcaccagaacatttatgacta

SEQ ID NO: 827 - DNA, 462 bp, Homo sapiens
  ENST00000515206
attttacgaacgaggacatcaaggccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaaggacaggggttggcagtggcagatgccgaagatgtggatgaccacacgggcgaacgaaggcccatgtcgttcaggaggccccgagcattggacacccaggccctgagacgtactcagttcggtctgcatctgttgatggtgaatattgcaggactgatagccactgaccgcctgtagtgatgtgtg

SEQ ID NO: 828 - DNA, 435 bp, Homo sapiens
  ENST00000504625
ccttggctgcgccccgccccgcccgttcctggcttcctcgatggcttcctcctcaggacgccggtctcccgccacggcgccctgagccaggctccagagcaggcggcttctctgggggaggccgggacccgcctgacaccgaggggaggcccaggcgtgacccggccccggtggctcctcggccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaag

SEQ ID NO: 829 - DNA, 2350 bp, Homo sapiens
  ENST00000506456
acgcacacgcagccacccacccacacaggcgcacatacgctggcaccgctgaacagccaaaatatacacgatggttcttcttatggttcaggaggtggaaagttgaaaccatagcaagaaacgtggcctatccaccgcagcgactaaaagataaagagggaaaaggacaaacattggccagaaggtgcagcggctggagcgttcgcgccttaactggaagaggagccgccccgcctgggaggccgctctggcgcccggctggtgccgggcaggaggcccttgcggacccagcggcctcctcgtcggcaacgcccaccccgcggttcagccacggagcggatgccgtgtgcaggcacggaacgggcgaggctgttgcgctgcaggtgcccccacggtcgcgatgcggggcagggggatgccgacggatgtaatgcaccagaacatttatgactacatccacgtggacgaccgccaggacttctgccggcagctccactgggccatggaccctccccaggtggtgtttgggcagcccccgcccttggagacaggagatgatgctatcctggggaggctgctcagggcccaggagtggggcacaggcacgcccaccgagtactcggccttcctgacccgctgcttcatctgccgtgtgcgctgcctgctggacagcacctcgggcttcctgacgatgcagtttcaaggaaaactaaaattcctgtttggacagaagaagaaggcgccgtcaggagccatgctcccgccgcggctgtcgctgttctgcattgcggcacccgttctcctcccctccgcagcggagatgaaaatgaggagcgcgctcctgagggcaaaacccagagcagacaccgcagccaccgcggatgcaaaagtaaaagccaccaccagtctgtgcgaatcggaactgcatggaaaacccaattactcagcaggaaggagcagcagagagagcggcgttttggtgctcagggaacagactgacgctggccgatgggcacaggttcccgccagggccccatgcctgtgcctccggggtggccctgaccttgtccttgaccccaaggggggctcaggggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctcagatctgtgtgtctacgctcagatgcgtcggtggctgggctgccctgctcctggtcaggccggagcccgtcctaagacacacgctttgcagagctgtgcatgcgcagtctgctagtgtgtgtgtgcagcatacgcaggagcctatcctgaattttgtaaaatatcccaacagttcttaaatgaaaactggccttaagtctattcaagcatgacagcatttctctttgaggaattaaaatctttaggaaagtga

SEQ ID NO: 830 - DNA, 569 bp, Homo sapiens
  ENST00000510910
gggaaaccgagtcacaaagagtccaagtcgacaggaaagtggatgtcttggccccagagtgtctgcggcccagaagatgcccgtctcttagcctcccgcttgccccgaaaggctggatgtgggcaccacttggcgggcagacgggtgggcgggtgctccaggcaacttagacatcttctcaggagggagtggggaaccggggccaagcgccgtctcttcggtgggattctctccctgtggctgtgacttgctttgacaagtggagtggaaatttttcggttactcgtcggtggaataaagtgtctaaagccacttggggtaaggctgaaataatcttgttgcgctatttcagacggatgtaatgcaccagaacatttatgactacatccacgtggacgaccgccaggacttctgccggcagctccactgggccatggaccctccccaggtggtgtttgggcagcccccgcccttggagacaggagatgatgctatcctggggaggctgctcagggcccaggagtggggcacaggcacgcccaccgagtactcggccttcctgacccgct

SEQ ID NO: 831 - DNA, 646 bp, Homo sapiens
  ENST00000511487
ctcctcccctccgcagcggagatgaaaatgaggagcgcgctcctgagggcaaaacccagagcagacaccgcagccaccgcggatgcaaaggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctggggg

SEQ ID NO: 832 - DNA, 2180 bp, Homo sapiens
  ENST00000507048
gatcagtgtgatgcgtgtgtgggtacacacacatgtcccgtgtgagttggtctccaactcacctcagtgttcacttcctggaacataactacctggagtcatgagaatggaccgtattttctttctggccttccaggaaaaaaatataagctctaaaaatcatcctatgattttatccttctactttctgaagcaaattcattagcccttcattggcctgaaaagtgacgtgacaatattttcagtaaacctgtaactgagaaaataactttccacactataaagaattaaacaagagtgaactattgtttctgtcttcactgctcaggtgtgacagcaatacctgtcattattaatttctaccatcaaaacatgtttcatccacatgtcatcttgttcatccgtcacatgtcacatgttcatctgtgttcttcacagagtaaaagccaccaccagtctgtgcgaatcggaactgcatggaaaacccaattactcagcaggtacttagaacatttcttatctgatcttttccacatgggtaaaatgtgtttctgcccttggagagcttccccgcccagtggagatgttggcgtattccatggaaaagccattttgcagagacttggtgtctgtcctgctgtggacaagtgccgttcctgggctctggtctgtgcatttctgaggagccgatgggtcctgccttgctgagaacaagcaaccgtcttccaggagctcctcagctcgcaccgtgacggcttcccccccctctaaaccccaacaggaaggagcagcagagagagcggcgttttggtgctcagggaacagactgacgctggccgatgggcacaggttcccgccagggccccatgcctgtgcctccggggtggccctgaccttgtccttgaccccaaggggggctcaggggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctcagatctgtgtgtctacgctcagatgcgtcggtggctgggctgccctgctcctggtcaggccggagcccgtcctaagacacacgctttgcagagctgtgcatgcgcagtctgctagtgtgtgtgtgcagcatacgcaggagcctatcctgaattttgtaaaatatcccaacagttcttaaatgaaaactggccttaagtctattcaagcatgacagcatttctctttgaggaattaaaatctttaggaaagtg

SEQ ID NO: 833 - DNA, 1048 bp, Homo sapiens
  ENST00000555133
ttctttgttttcctatgggtgaggaatggttgtatgagcagttgggtttcgggacgctttttggggagaacccgatggagtctgaaggatctctaaatcaggcggaacccacggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacgcgacagggctggcagcggtactactttgagggcattaaacagacctttggctatggcgcacgcttatttt

SEQ ID NO: 834 - DNA, 1402 bp, Homo sapiens
  ENST00000216479
ggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacgcgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaacatg

SEQ ID NO: 835 - DNA, 1173 bp, Homo sapiens
  ENST00000535854
aagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagaggggtctcactgtcactcaggctagagtgcagtggcataatcacagcaaactgcagccttaacctcccagacccaaacgatcctcctgcttcagcttcccaagtagctgagactacgtgtgccaccatgccagcttttttttttttttttttttttttacttttttacttttt

SEQ ID NO: 836 - DNA, 588 bp, Homo sapiens
  ENST00000554156
agttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggaggtttgtgcttcataactcctaatccgagtcctctatatcctcttattctcagatgagaaaagtgacctgtcattcag

SEQ ID NO: 837 - DNA, 832 bp, Homo sapiens
  ENST00000555517
aaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtaagtctaagctgggctgtcagagagattaactgtgttttgtttaacctgttaagtagctggagagaacagttttgaggagttacagaccttgaagggagaaggcagatgttgctgctttggagtcctatgtaaagcagtatcgagtcctggaatttctttgccattgtgggatgctaaatggatttcctgtgtctgggtctcataagtcccatccatgaagtggccgggccactgcatctttgggccttggtctttgttgggacacctacgatgatatttcttcagactagctacatgtatcttgtgagtgatttaaaaggaggaaggagaggatttttttggtcttgatctttgtgcactgtcttcagtgtgaatcttaacagattaaaccactgcgctaatgaa

SEQ ID NO: 838 - DNA, 787 bp, Homo sapiens
  ENST00000556963
cgctggatcgtggaggagcgggcggacgccaccaacgtcaacaactggcactggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacaggtatcccttgagtagttctgtatgccttaaggaggtagtttccacctgttagactctggttaagggcctggacagtcctttctttggcaaatgggtaaagatttggggggagggggcttatttcatcttaaagtcagtccataagctcggagtaagggaaagatctggagctgtgttgcctaataatgatggttgagcattttagatgtggctagaccaaactgaaatgtactgtgatggcctggcgcggtggctcacacttgtaatcccagcactgttggatgctgaggtgggctgattgcctgagctcaggaatttgagaccagcctgggcaacatggcg

SEQ ID NO: 839 - DNA, 432 bp, Homo sapiens
  ENST00000556866
tggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggtaa

SEQ ID NO: 840 - DNA, 763 bp, Homo sapiens
  ENST00000553374
gtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtgagtacctgccggccctagactcaggttattgcctctggtcagatgagtgacatttctctttttctgaactctataggtaaaatgtaaggctttaatctctttgttaataaaacattttgtttttcaaaaaaa

SEQ ID NO: 841 - DNA, 641 bp, Homo sapiens
  ENST00000555457
taacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagctggtgcaggcctttacccatgctcctgcaacattagaagcagacagaggtggaaagttccacatggtagatggcaacgtctctggggaatttactgatctggacactttgccaccatcaccttgaccttcatcgacaagaacggagagactgagctgtgcatggaaggtcgaggcatccctgctcctgaggaagagcggacgcgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaa

SEQ ID NO: 842 - DNA, 621 bp, Homo sapiens
  ENST00000555729
atggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacaggacactttgccaccatcaccttgaccttcatcgacaagaacggagagactgagctgtgcatggaaggtcgaggcatccctgctcctgaggaagagcggacgcgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaa

SEQ ID NO: 843 - DNA, 561 bp, Homo sapiens
  ENST00000555473
attttatcttttcagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacgcgacagggctggcagcggtactactttgagggcattaaacagacctttggctatggcgcacgcttattttagg

SEQ ID NO: 844 - DNA, 849 bp, Homo sapiens
  ENST00000556369
tgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagaggggtctcactgtcactcaggctagagtgcagtggcataatcacagcaaactgcagccttaacctcccagacccaaacgatcctcctgcttcagcttcccaatgctgggattacaggtgtgagccaccacgcccagccaggttgccccagtcttaaactcagatggaaacctagatatgaaacctccgtcccctctgcctttcccaggacactttgccaccatcaccttgaccttcatcgacaagaacggagagactgagctgtgcatggaaggtcgaggcatccctgctcctgaggaagagcggacgcgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaaca

SEQ ID NO: 845 - DNA, 584 bp, Homo sapiens
  ENST00000557476
agtctcgaactcctgggctcaagtgatcctcctgcctcagcctcccaaagtgctgggattacaggtgcatgccaccacgcccacgtaattttagtagagatggagtttcaccatgttagccaggctggtctggaactcctgacctctggtgatccgcccacctcagcctgccaaagtgctgggattacaggacactttgccaccatcaccttgaccttcatcgacaagaacggagagactgagctgtgcatggaaggtcgaggcatccctgctcctgaggaagagcggacgcgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaa

SEQ ID NO: 846 - DNA, 6398 bp, Homo sapiens
  ENST00000297625
gcgcaggggatcggcgggaagctctttcacccccgcttctgccgggctgtaactgcaatggagcaggttgagatgaactcagtcagatggccccacggcccgctcctttcttagcagcccactaatgctccagaaccctcaggagaagagccaggcctacccccgccgccgccggcctggctgctacgcataccgtcagaaccccgaggccatcgcagccgcagctatgtacaccttcctgcccgacaacttctcacctgccaagcccaagccttccaaagacctgaagccgctgctgggctccgcggttctggggctgctgcttgtgctggccgcggtggtggcctggtgctactacagcgtctccctacgcaaggcggagcgacttcgcgcggagctgctggacctgaaagctggcggcttctccatccgcaatcagaagggagagcaggtcttccgcctggccttccgctccggcgcgctggaccttgactcctgcagccgcgatggcgccctgctgggctgctcgctcacggccgacgggctgccgctgcacttcttcatccagactgtgcggcccaaggacacggtcatgtgctaccgcgtgcgctgggaggaggcagcgccgggccgggccgtggagcacgccatgttcttgggcgacgcggcggcccactggtatggtggcgccgagatgaggacgcaacactggcccatccgcctggatggccagcaggagccccagccgttcgtcaccagcgatgtctactcctccgacgccgcgtttgggggcatcctcgagcgctactggctatcttcgcgcgcggccgccatcaaagtcaatgactcagtgcccttccacctgggctggaacagcacggagcgctcgctgcggcttcaggcgcgctaccacgacacgccctacaagccacccgccggccgcgccgcagcgccagagctgagctaccgagtgtgcgtgggctcagacgtcacctccatccacaagtacatggtgcgtcgctacttcaacaagccgtcaagggtgccagcacccgaggccttccgagaccccatttggtccacatgggcgctgtacgggcgcgccgtggaccaggacaaggtgctgcgttttgcccaacagatccgcctgcaccacttcaacagcagccacctggaaatcgacgacatgtacacacctgcttatggcgacttcgacttcgatgaggtcaaattccccaacgccagcgacatgttccgccgcctgcgcgacgccggcttccgcgtcacgctctgggtgcacccttttgtcaactacaactcgtcgcgcttcggcgagggcgtggagcgcgagctgttcgtgcgcgaacccacgggccggttacctgcgctggtgcgctggtggaacggcatcggcgcggtgctagacttcacgcacccaaaggcccgcgactggttccagggacacctgcggcggctgcgctctcgctactccgtggcttccttcaagttcgacgcgggcgaggtcagctacctgccgcgggacttcagcacctaccggccgctgccggaccccagcgtctggagccggcgctacactgagatggcgctgcccttcttctcgctggcggaggtgcgcgtaggctaccagtcacagaacatctcctgcttcttccgcctggtggatcgcgactctgtgtggggctacgacctggggttgcgctcactcatccccgcggtgctcaccgtcagcatgctgggctacccattcatcctacccgatatggtgggcggcaacgccgtgccccagcggacagccggcggcgatgtgcccgagcgcgagctctacattcgctggctggaagtggccgcctttatgccggccatgcagttctctatcccgccctggcgctacgacgcggaagtggtggccatcgcgcagaagttcgccgccctgcgggcctcgcttgtggcaccgctgttgcttgagctggcgggcgaggtcaccgacacgggtgaccctatcgtgcgccccctttggtggattgcgcccggcgacgagacagctcaccgtatcgactcgcagttccttattggggacacgctgcttgtggccccggtgctggagccaggcaagcaggagcgcgacgtctatttgcccgccggcaagtggcgcagctacaagggtgagcttttcgacaagacgccggtgctgctcaccgattacccggtcgacctggatgagatcgcctactttacctgggcgtcctgacccagcccagggcccggtaaccgcaaagcccccagtcttcatgcagaccttgaaccctccgtcacacccgcaccatgtactcccaggaacctcccacctctataccacccattaagtggctgctgacttaaatgtgctggaaccagctgctgaaggtggggcctagggagggggcactgaagcaatctcctgctccaacgcacaatccttactgtgccctttccacccccacactcacaccaatctgcagaaacctcttccctggggtggaagccagagagcttagaggaaaaaggtcagctctcttcctgttatacatggttatacatggttggggtttaaaagcacaaagagaaacctccccctcctggctttcgtggccatctttgtccatcttaggtggggacttgatcttatttaaggtctccaaatagcccccaccacacttagaacgtgtgttttcttagtgttagaagccaggccctgagtccccagcactcacctgaactgtggctgatttggtcccagtccagctggggaggtgtttggctgacaaggaggcaagagatcccctcccagggaacaggaggactgggcttagcacagagccatcatcatgttcccaatttgtgaagagactcctaacactgcactaacccatttgtgtacatacatgggctcagccctgggccaaatgtgcctgatgggaacagacttgcagggccatgcaggccagacttcgtgccttaactgaagagtgtgcgtgtgtgtgtgtgagagagagagagagagagaaacacgcatcatgggtccctgatctatgaaatgaacacaacctctctgaggctggatgatctggaggaagggggcatggagcaaatttgaggctctgattgctgagccagcctcctcccaggcggtttccccaggactctcgtaggaaataaatagccctttcaagattcctcagctgcctcaccccctgcacatgtgcctggggtgtggcctagaagggagtgatgttcttactctggtggtctgtgcttctgaacacaggctacatgcacacactgacaactaccaataaacagacaggggaaggtctttcatctcagccattttctcttccccccgcccccccttagatggagtcttgctctgtcacccaggttggagtgcagtggcacaatcagctcactgcaacccctcctcctaggttcaagcgattgagtagctgagattacaggcatgcatcactatgcctggctttttgtattttttagtagagatggggtttaccatgttggccaggctagtctcaaactcctgacctagtgatgcacccaccttggcctcccaaagtgttgggattacaggcatgagccaccacgccagccattttctctttctaagaagagcaacctcagccggagtgagttttttctgactttgcagctgagtctggagaaaagtggcatgccagagcgggtcggtgggaaacagggtgaactttagcttccatcaacagctctggtagcaaaaccagtcccctaccccctagagaatgcatccgtttccccacctgatatggtttggctgtgtccccacctaaaactcatcttgaattgtagctcccataattgccatgtgttgtgggaaggacccagtgggagataattgaaatatgggggcagtttccgccatactgttctggtgatagtgaatagatctcatgagagctgatgattttataagaggtttccccttttgcttagttctcattctctcttgcctgccgccatgtaagacgtgcctttctgtcatgcttgtgaggcctccccagccacgtggagctgtgagttcattaaacctctttttctttataaattacccagtcttggttatgtctttatcagcactgtgaaaatgaacctatacagtaaattggtaccagtagagtggggcgctgctgtaaatacccaaaaatgtggaagcaactttggaactgggtaacaggcagaggttggaacagtttggagggatcagaagacaggaaaatgtgggaaagtttgggacttcctagagacttgttaaatggctttgaccaaaatgctgataatgattgggacatgaaatccaggctgagttggtctcagatagcgatgaggaacttgtttggtactggagtaaaggtgactcttgctatattttagcaaagagactggctgcattttgcccctgccctagagatttgtggaactttgaactcgagggagatgatttagggtatctggcagaagaaatttctaagcagcaaagcattcatgaggtgacttgggtgctgttaaaagcattcagttttaaaagggaaacagactataaaagtttggaaaatttgcagcctgatgatgagatagaaaagaaaaacccattttctgaggataaattcaagccccctgcagaaatttgcataagtaacaaggagccaaatgttaatcactaagacatggggaaaatgtctgcagggcatgtcagagacctttgcagcagtgcctcccatcacaggcctggaggcctaggagggaaaaaatggttttgtgggccaggcccaaggtccccttgctgtgtgcagcccagggacttggtaccatgcatcccagctgctctagtcatggctaaaaggggccaagatacagctcaggccttggcttcagagggtgcaagccccaagtcttggcatcttccacgtagtgttgagcctgcaggtgcacagaagtcaagaactgaggtttgggaacctctgcctagatttcagagaatgtatggaaatgcatgtatgtccaggcagaagtttgctacaggagtgaggccctcatggagaacctctgttaaggcaatgtggaaggggaagcccccacacagagaccccactgggacactgcctagtagagctgtcagaagaaggccaccgtcctccagacatcagaatggtatatccactgacagcttgcaccatgcacctggaaaagccacagacactcaacgccagcctgtaaaagcaaccgagaagtaggctgtaccctgcaatgccataggggtggagctgcccaagaccatgggaacccacctcctgcatcagtgtgacctggatgtgagacatggagtcaaaggagaccattttggagctttaagatttaactgccctgctggatttcagacttgcatggggcctttagccacttcgttttggccaacttctcccacttgaaatgggtgtatttagccaatgcctgtacctccgttgtatctaggaagtaactaactagcctttgattttacaggctcataggtggaagggacttgccttgtttcagatgagactttggagtatggacttttgagttaatgctgaaatgagttaagactttgggggactgttgggaaggcatgattgatttttaaatgagaggacatgagatttgggaggggccagggagagaatgatatggtttggctgtgtccccatccaaatatcaccttaaattgtagctcccataattgtgggagggacctggtgggagataattgaatcataggggcagtttctcccatactgttctggtggtagtgaataagtctcacgagatctgatggtttaataaggggtttccccttttgcttggctctcattctctcttgtctgctgccatgtaagatgtgccttttgccttccaccatgattgtgaggcctcccagccacatggaactgtgagttcattaaacctctttttcttcataaattacccagtctcgggtatgtctttatcagcagtgtgaaaacagactaatacaccactcctctaccttctttattttctcagtgtggaaaatgcctgatgaaagctttggggccctcacagatgcacaactcaagtgctgattctatcacttatctaccagctctgtgaccttgaacaagccgcttaaccttgctaagcctctgttttctcatatgtcaaatggtgataataatgcctacctcccgaggttgttgtaagaattataagcacaaatgtatgtaaagtgcctggcacaaagtaggtgctcaataaatggtagctattataat

SEQ ID NO: 847 - DNA, 480 bp, Homo sapiens
  ENST00000379142
ttcctgcccgacaacttctcacctgccaagcccaagccttccaaagacctgaagccgctgctgggctccgcggttctggggctgctgcttgtgctggccgcggtggtggcctggtgctactacagcgtctccctacgcaaggcggagcgacttcgcgcggagctgctggacctgaaagctggcggcttctccatccgcaatcagaagggagagcaggagccccagccgttcgtcaccagcgatgtctactcctccgacgccgcgtttgggggcatcctcgagcgctactggctatcttcgcgcgcggccgccatcaaagtcaatgactcagtgcccttccacctgggctggaacagcacggagcgctcgctgcggcttcaggcgcgctaccacgacacgccctacaagccacccgccggccgcgccgcagcgccagagctgagctaccgagtgtgcgtgggctcagacgtcacctccatc

SEQ ID NO: 848 - DNA, 834 bp, Homo sapiens
  ENST00000497030
ttacgtaaggcgcgagtcccgcgcggccggccggggctccgcgactgggcgggcggaggcggcgccgccctgcaggatccgggctggaagcctctcggagtgctgcctccagccaaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccgg

SEQ ID NO: 849 - DNA, 1043 bp, Homo sapiens
  ENST00000470888
tgtgtttatttgattgcttttggtggcgaggcgcggggctcgggctcgtcgcgcgccccatggccggggagcgcatccgccaaccccgggcggaggtgggcccctccgagcgcgcgcgggcggcgggcagcggcggcagctgagactccgggggatgtgacagccgccggggaggggacgagacgcagaccacacgttgcccacgtgcgaggaccgggcaggggctcagcccctaggccgcccggtgcgtggggcggcgggggctggctttgagtcacccccgcttgtgccagcttccccggctcggcggagactggcttggggatgcctggccgcccggcccccttctcggacgcggcgtggggagcgagctggagttaaggatgaaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaa

SEQ ID NO: 850 - DNA, 1335 bp, Homo sapiens
  ENST00000546702
gtgtttatttgattgcttttggtggcgaggcgcggggctcgggctcgtcgcgcgccccatggccggggagcgcatccgccaaccccgggcggagaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattct

SEQ ID NO: 851 - DNA, 6836 bp, Homo sapiens
  ENST00000327299
agtccgcctgctactcggtcccggcgctgggctgaggggaggggttgtcttaaaagtctctccttccccctgtaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttcttgttttgttttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccagcccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttata

SEQ ID NO: 852 - DNA, 928 bp, Homo sapiens
  ENST00000474968
ggggccgcgcgccggggaacctgtggcgccggggggctcgcagcctcgcgcctctccagcccctccacgcagcctcgggcctcggggcagagccctgggtggctttgaaaggcctgtctgttcgttgtcgccttctaagaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgt

SEQ ID NO: 853 - DNA, 867 bp, Homo sapiens
  ENST00000479060
cagtccaggcatgaagaggataatgagcttaacatacctgtgagaagtttcaggtggaggtatctggtggccttcggcacagcaagtgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagca

SEQ ID NO: 854 - DNA, 6887 bp, Homo sapiens
  ENST00000545314
ttacgtaaggcgcgagtcccgcgcggccggccggggctccgcgactgggcgggcggaggcggcgccgccctgcaggatccgggctggaagcctctcggagtgctgcctccagccaaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttcttgttttgttttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccagcccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 855 - DNA, 6998 bp, Homo sapiens
  ENST00000395334
agccgccggggaggggacgagacgcagaccacacgttgcccacgtgcgaggaccgggcaggggctcagcccctaggccgcccggtgcgtggggcggcgggggctggctttgagtcacccccgcttgtgccagcttccccggctcggcggagactggcttggggatgcctggccgcccggcccccttctcggacgcggcgtggggagcgagctggagttaaggatgaaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttcttgttttgttttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccagcccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 856 - DNA, 523 bp, Homo sapiens
  ENST00000580650
acaaatctatcttaaatgtcagtccaatatccacggcgacgagccacagcaggtgagaaacctggaaatgagcctgaagaggtgaagctgcagaatgccagcaaacagattgtgcagaatgcaatcctgcaagctgtgcagcaagtctcccaggagagtcagcgcagagaagagagaatcagtgacaaccgggaccacatccaactgggcgttggggagttaaccaagaagcacgaaaagaagtaacatggtggatttggctcttgacatgtgcttggtttctagccttcctcttagtataggacgcatctccaaaatgttgccagtaaagcaaaccgaagtgtcaccggcacctagctgtagaatgaattcacactagcccctggctgagaagcactgttttgaaaaagtgcattagacgattctgttcatatttatgcagtgcctctgagacatagtggggccaaatatgacactgtaattgcaaaagtagttttgcaggccaatttatttttaaagttct

SEQ ID NO: 857 - DNA, 575 bp, Homo sapiens
  ENST00000434239
agctgcggccccaggatctagcggcgggagctgtccggggtgctgaccgccccgcccgccgcccgcccagcgcgccctcctgcaccggaccccgccaagtccggccttcttcccatcctccgtctgcctgtctttctctcttaatctgggggcgtagcggctggaagaaatcatggtgttcgctccaggtgagaaacctggaaatgagcctgaagaggtgaagctgcagaatgccagcaaacagattgtgcagaatgcaatcctgcaagctgtgcagcaagtctcccaggagagtcagcgcagagaagagagaatcagtgacaaccgggaccacatccaactgggcgttggggagttaaccaagaagcacgaaaagaagtaacatggtggatttggctcttgacatgtgcttggtttctagccttcctcttagtataggacgcatctccaaaatgttgccagtaaagcaaaccgaagtgtcaccggcacctagctgtagaatgaattcacactagcccctggctgagaagcactgttttgaaaaagtgcattagacgattctgttcatatttatg

SEQ ID NO: 858 - DNA, 712 bp, Homo sapiens
  ENST00000560571
agcgtctttcggcgcatgcgcggactggagctgtgtgcagggccagcgcggagcccgagcagccgcggtgaagcgcctgtgctctgccgagactgccgtgcccattgctcgcctcggtcgccgccgctttagccgcctccgggggagcggccgcctattgtctttctccgcggcgaaggtgaagagttgtcccagctcggcccgcgggggagccccgggagccgcacgatcccggaattcacaatgaaaattggattgagcggtattttggtgttcattctttgctaatgacactccttaatgaagttatttggagagtttattgcttcagtacagtaaaaaccagtgtgcctttttttttgttagtagtcccccccacaacaagtgttttatttttagaagaagcattttcttcagtttttctgaactgttggattgcgcagatgaggacaaacggtgcagttcttgaaaggtcattattggcaagtttgtgaagaagctaagatcagttgagataaatcattgttactattcttgtattctgtcgtggactcttggggatttgcaggctgcattaagtacaagttttgtcaagtttgggtgcacatattacacttaatttggtttgtgtggcttattatatgaacatgattctgtttcagttccccagatggaactagcttaaatgtctgtcattcatagtggagcaaaa

SEQ ID NO: 859 - DNA, 5459 bp, Homo sapiens
  ENST00000559362
tgcgcggactggagctgtgtgcagggccagcgcggagcccgagcagccgcggtgaagcgcctgtgctctgccgagactgccgtgcccattgctcgcctcggtcgccgccgctttagccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgctgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagtaggcctgtccacatcctccactgctgcagagcttcagcacgggatggggaataccagtctcacaggacttggtggagagcatgagggtcccgcccctccagcaatcccagaagctctgaatatcaaggggaacactgactcttccctgcaaagtgtgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctccgctctgttgccatgtctgttgccagatgggtctgatgggtccgatgctcttaactgcagtcagccttctcctctggatgttggagtgaagaacactcaatcccagggaaaaactagtgcctgtgaggtgagtggagatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcatgcgagccccgccttcaggcagggaaaggagcactccctctctaccttgcatggtctctgcccaggacgcacctctgcctaagggggcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaag

SEQ ID NO: 860 - DNA, 3765 bp, Homo sapiens
  ENST00000560302
gaagcgcctgtgctctgccgagactgccgtgcccattgctcgcctcggtcgccgccgctttagccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatggtgagaatttatatgatctacaaacacactttaagtttgtgatatttctactttttttttaatggggctacttttctatggtcatcatattcaggtcttccacagaggctgcgtaaatcttagaattactgtaggaaagtggcctcaatggcatctcttctaggttcttcaattgagctgttaagcatgttgttgcagcgaaatgaccctagggattacccaaggagagtggcacgtcaccttcctgtgggtctggatttcagatttgatctctcaagtgtagaaagtgacatgctcttcatgaggagagtagcagagttactttttggtgtttaatgatcaaagacatggttttcattattgtattctgaagttctctaaagatagcctggaagtgaaggagaggaaagattgggcagtgagtgggaggagcatgagaacagggtgtgctctgagaaaccacacacttccttaaccaggttagtgtcactcttactgactttatctgttggccctccctatgagagttcactgaagaaaggactttttgtttgttttttgtttttttttgagaacgggctttcactcttgtagtccaggctggagtgcagtggcatgatctcggctcactgcagcctccacctcctgggttcaggtgattctgctgcctcagcctcccaaatagctgggattacaggcatgtaccaccatgcctagcaaatttttttttttttttaattagagacagggtttcaccgtgttagtcaggctggtctcgaactcctgacctcaggtaatctacccacctcggcctcccaaagtgctgggattataggcatgagccactgcgcccggccagaactccactttttcaaaaatatttacatagtaagtcctcttactcaaacaagggttttcccacataattctagtagccaatgacatctacttgatgtcataattgtatagatattttttaatgaaacataatgtgtacctggagttcaataagtaacatccagtttcccttctgagttcaagtccaattgaacgatttgggagtcctgagatagaaaccaaaatgtttattactgatgaaatctagattggaagcctgatgttagagctcctgccagaagggtctgcttgtactttctatgtcttcaatgaaagagctggtcagtcacaccattgccctgtagagtccacccagccttgagtattgaattattttgggtaagcagaccacaagtcactctccccacaggtgagcagttcctgaggagaaatacccagaggggcctgagccatagcatagttagtttctacactcagatgaattttgtcttcttccatggaagaatggtaaagaggtctttgccagctttgattctcttaaatctacactaaatttaacagttaaacctgtggtcagccgtcagaacggtgtcccatactgtcaggtgcatactgtcagattctacctggatagtcctgcccaggtaaaacctgaaaggaagtatcaaatcaaggaagaaaggatttatccttttcttcttctttttttaagtatagtgtccaagaaacttctgtcttgctaatatttagagatcagaatatttgacattctgaaaaggcactcatgccttatataaacctggtgatgggccttaatacctctagctcctcctatttctgtattgatacaggaatgtttattctggctgcctttcacaaatcagtgtcaagatagtactgcattagttatttgtggggcttatggtgttttatggttttgttttgtcttgtttaaagaggggcccaggagttggatagttttatgttgccatgattaaaaacaactattagaaaaagcaaacatctgaaactttggacatatcacttcctctttctctctcttttttttttttttttttgagatagagtcttgctctgtcgcccaggctggagtgcaatggtgcaatctcggctcactgcaacctccatctcctgggttgaagcgattctcctgccttagcctcccaagtagctgggaatacaggcacatgccaccacaccctgctgcttttttgtgtgttttagtagagacggggtttcaccatgttgcccaggctggtcttgaactcctgagctcaggcaatccacccgcctcagcctcccaaagtgctaggattacaggcgtgagccactgtgcccggccacttcctctctttgggccttaacttccttgtctttaataggagggaattggccagctttaatttttttttgtactgtcagtgtactggtaaattttctgttgcacaaaattgctcaagcagtgctaacaaaggccaaaccaaatttgaacacttgaggaaggaaatacatattaaaaccacaatgagatatcattacacatttatcataatggctaagatgaagaataccaagtgctggcaaagatgaagaacatatcatatgttgcttgtaggaatgcaaaatgtataaccactctagaaatatttggcagtttcttgtaaagttaaacatacacttagcgtatgacccagtaatcccacttttgggtgtttatcctagagaaatgaaaatctgtagtcaccaaaaagtctgtgcacggacgtgctcatagtaatgttattcataatcttcaaaaactggaaataacccagatttccctcactgagtgaatacagaagcaaactataatatatccatacagtggaatactactcagcaataaaaagaagcaaactgttgacatgtgcaacaacttggatgtgttttaaatgcattatgcgggaaaatgaagtcagtttccaaaggttccatactatgtgattctatttatatgatattctggaagatgcaaaattatagaaaaagagaacagatgagtagttgctaggggctgggagtgggggaagtctgactggaaagaggtatcatgagggaattctttgggttgttggagttgttttgtcttgttcgtggtggtggctgtaagaatctatgcatgtgttaaaactcataggagtgtacatcccctaaaggtgaattttattgtacatatatttaaaataataaaataacaaa

SEQ ID NO: 861 - DNA, 13215 bp, Homo sapiens
  ENST00000394518
gagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgctgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagtaggcctgtccacatcctccactgctgcagagcttcagcacgggatggggaataccagtctcacaggacttggtggagagcatgagggtcccgcccctccagcaatcccagaagctctgaatatcaaggggaacactgactcttccctgcaaagtgtgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctccgctctgttgccatgtctgttgccagatgggtctgatgggtccgatgctcttaactgcagtcagccttctcctctggatgttggagtgaagaacactcaatcccagggaaaaactagtgcctgtgaggtgagtggagatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcatgcgagccccgccttcaggcagggaaaggagcactccctctctaccttgcatggtctctgcccaggacgcacctctgcctaagggggcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagtaggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgaatgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccgtgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattctgtcatcagatccagaagaaatatcctggttttccagcatgtttacccacatgttttggccatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtttccacgccgggacaccatgttctccatcaagctaaagaaatcacgtgcctgaaactgtgcttaagttttgggggaaagatggagttcctatccagagcccccagatttccagaatcgagtgagcttcctggaaggagactgcgtcttctctcaattccagtcatctcagtcgttgtcgttaggtgacatgtgcactttaaatgctctcatcggttggcttcattttcaagacaatcaaatgtattgactgtgttttcttcttagaaaatggagagggttaaaaacatgcaaactgccactttcaacctttgccagtattccctctacccccgtgagagctatctggggggaagaatccttaccaaggtttttttggaaaggtacgaatcttaacttttttccccttctgtgtctcagggtaatactattcagagtcgcccctttgctcattttctcccgtatttgttaccttcctgaggcctcagtattagtcgtgagcacaaagttttgagacctttggcgttgtttcttgatgtgggaggggaggtgttagtgcatgcaagggttgaactagatagaccctgccttagtagagggtgggactataaccttagaggccagaacttgatccagaagttgctgtccacagaagtgctttctatttcatcatttttgtttctagggctctttttctgtagccaggtcttcccaaggattttagtatttgcattggagttgaggtttactctaatgatggtggcccagctgtgcccagaggacagccaggcaggccctgggagggagtttagaaagacagtcctggtgaatgggcttcaagtggtcacaaagagggtggctgtgaggtgaccccagacactgcagaacgatgtgcaccctctgcgttttggatgtccttggaatgtgggagcctagaaataaccctgtggatggaattggggcagcggctgctggagatctgtgtgccttgccttccttcagcaggaccgtctaggtgcgcagccacctatggatgcgtcccagccagccccgtcgctctcgtccatcctcagagacaaagaagagggcagggagtttgggcttggttttgaactttcctttcaatgtagcaaagcattcctagttaaccagagccttggaatctactgcctgctggccaggctttaaaatgaaaagtgttttaatgctgccataaaagggaggcgggggggaggaagggaaaataaaggcatctttccaagtactcatctaatttaattgtcaaaagattgataggccatgaattacttctccatctcactaagggttaaaggcgtgcaaccccccactggctgtgtcccctgccaccgaagtgagtgacctgccctacaaccaggtgggaccacctgtgctgcagtccggaggggcttctgcaggaagcactcaccccccacaccttccccggcctgagcttcccctacctttcgtcaccacctgagggcatgagcacaggccatggggcgtgcctggtgagtctgcctgtggttcaggcttagcctgtggtctcctgtgtgctgctgcccgcatgggatgcgcaggggaggcgtggggatccgcaggagggtggttgggatacaccggatacctctgctctcattgcttgtttgcaaatgctctatggacatttgtgtgctaaatcctattaaataaaaaagacgggttaaaacccagatgctgtatattcatttgtaattatgtataaagtgaagcagttttaaactgtaaagatttttttcagtgtgttttctcgaattttgccacaacatactggcttcgtattttatttatctttctttctagttaccagcttcagacccttgtaaagtctccctcagccctttcaaaaaataataaatttcctgtgaagtt

SEQ ID NO: 862 - DNA, 9468 bp, Homo sapiens
  ENST00000361243
tgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgctgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagtaggcctgtccacatcctccactgctgcagagcttcagcacgggatggggaataccagtctcacaggacttggtggagagcatgagggtcccgcccctccagcaatcccagaagctctgaatatcaaggggaacactgactcttccctgcaaagtgtgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctccgctctgttgccatgtctgttgccagatgggtctgatgggtccgatgctcttaactgcagtcagccttctcctctggatgttggagtgaagaacactcaatcccagggaaaaactagtgcctgtgaggtgagtggagatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcatgcgagccccgccttcaggcagggaaaggagcactccctctctaccttgcatggtctctgcccaggacgcacctctgcctaagggggcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagtatgagctggtgcccctctggtgtgcagtactctgctggcctgagtgctgactttaattacagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagtaggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgaatgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccgtgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattctgtcatcagatccagaagaaatatcctggttttccagcatgtttacccacatgttttggccatggataaagtgaagaggcctactcaccattatccctgcagcgtgacaccttttgattgtcactgaccactcagaaggggccacggcctcctggctgtgttcctgag

SEQ ID NO: 863 - DNA, 322 bp, Homo sapiens
  ENST00000560256
gttgtcccagctcggcccgcgggggagccccgggagccgcacgggacatgtatagtttcaccatgttggccaggatggtctgaaactccttatctgaagtgatcagcctgccttgacctcccaaaattctgggattacaggcgtgtgccaccgcgtctgtcctaaggagacacactgtttctctggcttattaagagtgtcctgggtcatgaaacttaatccacagcaagctcccttatatggtgattgtgttgttacagtgctgcttgctgaagaggacaaagctgaagatgatgtagtgttttacttggtatttttgggt

SEQ ID NO: 864 - DNA, 558 bp, Homo sapiens
  ENST00000558166
attgtgtgtttgccgcaaattaaaacctcagctctgtatcttgccttctgctggaggtttgtaagcttgctcctgctaaccacttcattgtctgagagagaaacggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaa

SEQ ID NO: 865 - DNA, 447 bp, Homo sapiens
  ENST00000558811
aaaagaggatgggcttgcgatattcggggtgcttgggcagccatgtggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtg

SEQ ID NO: 866 - DNA, 553 bp, Homo sapiens
  ENST00000560340
tcacacagcagcctgttccatctgtgggtaaccatgttccgaggcagcaaagagaaaccgctattgctccgtggaaataaactatctgaataaaacttcttaacgggggttgaggctgaagctgaaacgggagtcggacacgatcttggctcctgaagtctttaaaggtcagtttgatgcacacttctataccaccacctgttaccagctgtagacagaagacctatctccatgcttgcccctaggcttttgtagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactc

SEQ ID NO: 867 - DNA, 3297 bp, Homo sapiens
  ENST00000560676
atcggccgttatgcttagccagtttattctttatttttttactggagtcattgccagtgatggaaacggtgtttgcttctctttcagtcaagatctgcacaaagtatagcattaggtggtatttattgtttatattatgagttctacattcatctttccagcactctgaagttatcagcaagttctcagtcagttcaaggcattggattctgcttgatttctttttaattcattgtttttgacccctttgagagttttaatagagaggagtctggaaggcagagatctccaccacctaaccgtgagaaatttggaactaaggacttgcactggtccccaagttaacagtggatatacttcctgcattttctctgttctttcttgcatttgggcaaaatgtatgaacggcacaagaggcgctacagcctctgtgacatctccaaggtggacaggactgtggacgtggtattgctgaagataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagtaggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgag

SEQ ID NO: 868 - DNA, 4290 bp, Homo sapiens
  ENST00000560579
atgttgtatataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagtaggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctga

SEQ ID NO: 869 - DNA, 827 bp, Homo sapiens
  ENST00000559486
cccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtatgagctggtgcccctctggtgtgcagtactctgctggcctgagtgctgactttaattacagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattgga

SEQ ID NO: 870 - DNA, 425 bp, Homo sapiens
  ENST00000612418
gtctaaaactctcttttctcttggctcttcttattcgagtgatgaggaggaggagttgcataattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaa

SEQ ID NO: 871 - DNA, 751 bp, Homo sapiens
  ENST00000560957
cttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagtgagtatcactgtgggcattgcttgtgatcacctcagtaggatcctgtcacagcctgcattcacaccaaaactggttaaatcatggggacataaatggaaataaattcaggattactctccgaaatcgcctaatatttaaaggaaaataataagaagaaaaatagcaagaagtggaactaccagttactgagttttcactatatgctaagtgctttccatatattatttaaccctttcaacaaccctgtcaggtaggtgttatctctcttttctaaaagtgatgtaccttaccgaggatactcctctaatgtgaagaagtagttcaaaccagatctctttggtttcaaatcccatactcttaaaccacagtgcttaaatctgtaatatcagtttaaatgcaacagaaggattttatgcaaagatcaaaggattgaaaatatttatatttggctttagagggaaggattatcccacagaagattacaagaacttttaagactaatatgatttcttagatctatttctaattaggagcatttggaatatattctcttagtgattaagagattaa

SEQ ID NO: 872 - DNA, 620 bp, Homo sapiens
  ENST00000558092
acaaacaatctcggctcactgcaccctccacctcccgggttcaagcgattttcctgcctcagcttcccgggtagctgggactacaggcgtggtggcatgtgcctttagtcccagcttactctagaggctgaggcaggaagattgcgtgagctcaggagttcaaggctgcagtgagctatcatcacaccactcagagcaagactgtctccaaaacagacaagtgaacaagaaaacattagtgacggatctaaggaaacttagccaagttttgataacagaacctgggcgttgtggcatactctataaaaagccattcagcagccttcatctaccttttattctgcttcacttttatttaacttctgtagccctttaaaaaaaatcaatcttcttgtttttatttagtataacagaagagaactataatttcctgccacatagcccctccaagaaagattctgaatggaagagtggaacaaaagtcagtcgtacattcagctacatcaagaataaaatgtctagcagcaagaagagcaaagtgagtatcactgtgggcattgcttgtgatcacctcagtaggatcctgtcacagcctgcattcacaccaaaactggttaaat

SEQ ID NO: 873 - DNA, 660 bp, Homo sapiens
  ENST00000557852
aggaaacaagcagcctcagccctccctccttccctttctcagccagtctctggcttcctcttacgatttcactaatggcagctcaaagctgctgagctctgccctgacggcatgcgcccccgcttctgtgagagcacgcttcctggcatgggggtcgaatcatgtcgataaaatgggctcggtttcatgaagtaccccacataacagtgagattcataggaccaaagcatggggaggaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtg

SEQ ID NO: 874 - DNA, 683 bp, Homo sapiens
  ENST00000560482
gcgtgccaacgccttaatttaaaaaaacaaaacaaaacactttgcccagaactttgtttctcactcctttccaaaatagtcaccagctgttgttaaccacatgccatctgggtgcccaggtaaggagaaagccctccagtgttcaattaactgtggattattttcttttcttcggcaggaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagact

SEQ ID NO: 875 - DNA, 441 bp, Homo sapiens
  ENST00000559278
gctgggacacagggtgcttagggcagtgcaaaaagcagagtgggaaaggaagctgaactgcttgctcccttcctactcggcttctcagggcttgtcagaggtgaattgtcaatggacttactttctttctctttagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcact

SEQ ID NO: 876 - DNA, 1401 bp, Homo sapiens
  ENST00000558644
gacataagcaatttgtcttcagtcactgtagtacttccagccagttgtcattctagagtcttcaggtactcatttaagaatgcaagccataggttatcagaatgtatttgacagtatgtatttttcttttgtccccagagttggcaatgatgagaacatgtcaaacacctggaaattcctgtctcattcaacagactcactaaataaaatcagcaaggtcaatgagtcaacagaatcacttactgatgagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccct

SEQ ID NO: 877 - DNA, 322 bp, Homo sapiens
  ENST00000559820
aaagcagaaagatcgcttgagcccaggaggttgaggctgcaatgagccatgacttcagcctgcacttcagcctggagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaa

SEQ ID NO: 878 - DNA, 427 bp, Homo sapiens
  ENST00000558009
cagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaaggtattgataagaaacatgaaaatccccgttattgttgagagccatgtgtccctgtcggctttcactagagcctttttcatgtgattcctcacagtctgtttactcccttgcagaagaagatgagcagttcagttgttagaaggcttggaattccagagtgcatattgcttgtaactcagcggatta

SEQ ID NO: 879 - DNA, 418 bp, Homo sapiens
  ENST00000559391
ggagaacggaatcagatagtggcctaaaaaagggtggaaatgctaacctggtatttatgcttaaaagaaacagtgagcaggttgtccagagcgttgttcatctctacgagctcctcagcgctctgcaggtgcgtgccttcatcttccatccctgcgtttatttgtctagagaacagcagcttggggctgttgttgacttggatctttgaggtttgcaggatgtttaatggataaatggggccctcagtctagggaagactggctctcgtggtgagaaagttacagaatgcatcgaccttccaggactagaattagtgaagagctggtgtgccgtaggcatggcttgataaccatgctacaaatcacatagcatgctaacatgcatctgggagattacttcactttagaaagccttaag

SEQ ID NO: 880 - DNA, 611 bp, Homo sapiens
  ENST00000560185
gtcgttaggtgacatgtgcactttaaatgctctcatcggttggcttcattttcaagacaatcaaatgtattgactgtgttttcttcttagaaaatggagagggttaaaaacatgcaaactgccactttcaacctttgccagtattccctctacccccgtgagagctatctggggggaagaatccttaccaaggtttttttggaaagggttaaaggcgtgcaaccccccactggctgtgtcccctgccaccgaagtgagtgacctgccctacaaccaggtgggaccacctgtgctgcagtccggaggggcttctgcaggaagcactcaccccccacaccttccccggcctgagcttcccctacctttcgtcaccacctgagggcatgagcacaggccatggggcgtgcctggtgagtctgcctgtggttcaggcttagcctgtggtctcctgtgtgctgctgcccgcatgggatgcgcaggggaggcgtggggatccgcaggagggtggttgggatacaccggatacctctgctctcattgcttgtttgcaaatgctctatggacatttgtgtgctaaatcctattaaataaaaaagacgggttaaaaccca

SEQ ID NO: 881 - DNA, 9128 bp, Homo sapiens
  ENST00000394510
ttttaatagagaggagtctggaaggcagagatctccaccacctaaccgtgagaaatttggaactaaggacttgcactggtccccaagttaacagtggatatacttcctgcattttctctgttctttcttgcatttgggcaaaatgtatgaacggcacaagaggcgctacagcctctgtgacatctccaaggtggacaggactgtggacgtggtattgctgaagataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagtaggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgaatgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccgtgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattctgtcatcagatccagaagaaatatcctggttttccagcatgtttacccacatgttttggccatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtttccacgccgggacaccatgttctccatcaagctaaagaaatcacgtgcctgaaactgtgcttaagttttgggggaaagatggagttcctatccagagcccccagatttccagaatcgagtgagcttcctggaaggagactgcgtcttctctcaattccagtcatctcagtcgttgtcgttaggtgacatgtgcactttaaatgctctcatcggttggcttcattttcaagacaatcaaatgtattgactgtgttttcttcttagaaaatggagagggttaaaaacatgcaaactgccactttcaacctttgccagtattccctctacccccgtgagagctatctggggggaagaatccttaccaaggtttttttggaaaggtacgaatcttaacttttttccccttctgtgtctcagggtaatactattcagagtcgcccctttgctcattttctcccgtatttgttaccttcctgaggcctcagtattagtcgtgagcacaaagttttgagacctttggcgttgtttcttgatgtgggaggggaggtgttagtgcatgcaagggttgaactagatagaccctgccttagtagagggtgggactataaccttagaggccagaacttgatccagaagttgctgtccacagaagtgctttctatttcatcatttttgtttctagggctctttttctgtagccaggtcttcccaaggattttagtatttgcattggagttgaggtttactctaatgatggtggcccagctgtgcccagaggacagccaggcaggccctgggagggagtttagaaagacagtcctggtgaatgggcttcaagtggtcacaaagagggtggctgtgaggtgaccccagacactgcagaacgatgtgcaccctctgcgttttggatgtccttggaatgtgggagcctagaaataaccctgtggatggaattggggcagcggctgctggagatctgtgtgccttgccttccttcagcaggaccgtctaggtgcgcagccacctatggatgcgtcccagccagccccgtcgctctcgtccatcctcagagacaaagaagagggcagggagtttgggcttggttttgaactttcctttcaatgtagcaaagcattcctagttaaccagagccttggaatctactgcctgctggccaggctttaaaatgaaaagtgttttaatgctgccataaaagggaggcgggggggaggaagggaaaataaaggcatctttccaagtactcatctaatttaattgtcaaaagattgataggccatgaattacttctccatctcactaagggttaaaggcgtgcaaccccccactggctgtgtcccctgccaccgaagtgagtgacctgccctacaaccaggtgggaccacctgtgctgcagtccggaggggcttctgcaggaagcactcaccccccacaccttccccggcctgagcttcccctacctttcgtcaccacctgagggcatgagcacaggccatggggcgtgcctggtgagtctgcctgtggttcaggcttagcctgtggtctcctgtgtgctgctgcccgcatgggatgcgcaggggaggcgtggggatccgcaggagggtggttgggatacaccggatacctctgctctcattgcttgtttgcaaatgctctatggacatttgtgtgctaaatcctattaaataaaaaagacgggttaaaacccagatgctgtatattcatttgtaattatgtataaagtgaagcagttttaaactgtaaagatttttttcagtgtgttttctcgaattttgccacaacatactggcttcgtattttatttatctttctttctagttaccagcttcagacccttgtaaagtctccctcagccctttcaaaaaataataaatttcctgtgaagttctg

SEQ ID NO: 882 - DNA, 5464 bp, Homo sapiens
  ENST00000374088
ccagggcgcaatggagacagggggctccctgggtttggaacaaagaattcacaggcaggtcccctgaaactgggtcggcaggacggtggtggagcccgagagagggcacaggcaggatggccgatgctgacaggaaccagcggtgactctggggcccctggcagcagctctgtctcctgaagatgaagtggcccaggtgaagcccaggccagccccaatggccagctcggagactgagatccgctgggctgagcctggcctggggaagggcccccagcggcggcgctgggcctgggccgaggacaagagggatgtggatagaagtagttcacaaagctgggaagaagagagactctttcccaatgccaccagccccgagctcctagaggacttccgcctggcccagcagcacctgccgcccctggagtgggacccacacccgcagcccgatgggcatcaggattccgagtcaggagagacttcgggagaagaggctgaagcagaggatgtggacagcccagcaagttcccatgagcctcttgcctggctcccccagcagggccgtcagctggacatgactgaagaggagccagatgggaccctcggaagtctggaggttgaggaggctggagagagctcctcaaggttggggtatgaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtggagtcctttgaaagactgatacaggcaggacgtctcatgccccaggaccaagtcaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggaggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatggcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagaccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcatcttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcgtttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatcttaaaaaaagaaaagaagacaaaaaaaatacccaaagcca

SEQ ID NO: 883 - DNA, 3894 bp, Homo sapiens
  ENST00000492875
gagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggtaggtcaggagggagggccgggatgggtgcagctcctggtgtcagcgggggctcctctgttatgagaagccctttccatatacccagtgggccattcaaatatcattttctatcagttctgtgatatgaaaaccagcagggagcattgcctccatgaatctcggtgcacttgttcattcattcattcattcattcattcagcaaacactttctgatgcttcccctttgccagggcccatgcttggttctgggaagtctgttcagctggtcaatcctaaagaagttctgatcacctgtgcttttccggctcggagcatacagggtggacactgaattggatgtcccatttgcacctggcttccttcaggttctcatttccagagggcccctgtgtctcaggaaacaggacctggcacagagtaaagacttgagatgacacatggtagcatttcaagtgcttataacattaacacaaaaatatgggttgggtgtggtggctcacacctctaatcccagcactttgggaggccgaggtgggagaatcacctgagatcagtagttcaagaccagcctggccaatgtgacaaaaccccgtttctactaaacatgcaaaaaaaattagctgggtgtggtggcgggtgcctgtaatcccagctatttgggaggctgaggcacaagaatctcttgaacccaggaggcagaggttgcagtgagccaagatcatgccattgcactccagcctgggtgacagtgagactccgtctcaaaaatacataaatatatatatatatatatatatatggatatggttctcaccttcatgaatctgactgtagcagagaagatgataaccaataggtaattatagtaaaggcatcatctctcacagacaccttgcagaagagggagggctgctgacctcagattctggggacaaggcaagaggccagaggcacattctgctccatggaccataacgagggagtggacagaggccaaggagttagaaacgacagtagcaggaacacctccaagctcaccggacaatctctctgtggacttactagcaaaaggaaagagatgatatcattggatgaggttttctgtagcctttaaaggtgatcttaacccttaatagtgagcttaacctggagaaatgcttccaacacaatgagaggaagagagtatagaagtcaaaaccaaagactctgaagtcagtctcacagaaaatggctctgagcctctctgaccctcagattcctcatctgtcgcgtcgggaaaataagagcaattacgttcagctccacatacacaaagccagaacagcacaggagggaaatgagatgatgagaccgctccacagtggcttcaggtgtcacccagaaggccttatttgaaactcaggggtgggtaaggcaggaggtggtggggctgggtgaggaggccacagtccgcccagctttctcataacatcaactgctttccatctgccaggcactgggcggagcacgacacggatacggccccgttcagttctcccaacaagcctgtgaaatgggcgctatgtttatccccatgttacagccgctcagagcatggggagaaaacaccactgaccctgtgcccgagccattcagaaccaaaccagcaagtcggggtgtggggaatagcatcacttgttcatttcttattgttgctttgcttatcatttcttcctggcctgctttcaaatcctgacttagcctgggtgtgttggttgctactggatgtcagctggttctaggatctgagatgaaacagaataggagtctggagaaagcttacaataaacagacacaaagatgttcggtgacgtatatgtgtgtatgtgtgtcatacttaaatatgtacatattttacacatgatgtgtgtatgcacactcaccgtgtgcacacgtgagagagagacagagactattaaaaccatttggaggaagaggagatcattattccagaatcttcctctattttgcatccatccacagggctgatactgacagttctggtttctttccccaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcatcttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcgtttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatcttaaaaaaagaaaagaagacaaaaaaaatacccaaa

SEQ ID NO: 884 - DNA, 4414 bp, Homo sapiens
  ENST00000223791
gagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagcctgggggcagccctggccctgccacttggcatcttggtgaccctggggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtggagtcctttgaaagactgatacaggcaggacgtctcatgccccaggaccaagtcaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggaggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatggcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagaccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcatcttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcgtttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatctt

SEQ ID NO: 885 - DNA, 5038 bp, Homo sapiens
  ENST00000374075
gtgatgaggaaatggaagccagagagttgaagtgacttagggtaagttacaaggtgggtgcagagctggtatatgctaagaagtgaatggcctgtctttccagaggctgaagcagaggatgtggacagcccagcaagttcccatgagcctcttgcctggctcccccagcagggccgtcagctggacatgactgaagaggagccagatgggaccctcggaagtctggaggttgaggaggctggagagagctcctcaaggttggggtatgaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtggagtcctttgaaagactgatacaggcaggacgtctcatgccccaggaccaagtcaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggaggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatggcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagaccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcatcttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcgtttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatctt

SEQ ID NO: 886 - DNA, 241 bp, Homo sapiens
  ENST00000491133
ctggggcacagccaggaagaggcctccactccttctgacacagtcatctgagcgctcatgtctgctggaggcggcaccaggggatactcacccaggagtccaggggccaccagccaggccatctgtgagctgcaagaagaggtgtcccggcttcgtctgcggctggaagacagcctgcaccagccactccagggcagcccgacacgcccagcatctgcctttgaccgccccgcccggaccc

SEQ ID NO: 887 - DNA, 535 bp, Homo sapiens
  ENST00000490767
agtgccttgccctaggtcacacagctagaaggtggcagaaccaggctgggcagccagggatgtctgactccagagcttgtgccctgggctgcttggctcccaggacaggccaacccctgcgtcagggctgcctggcagaactcaaggatggtcttctcttcccatgccagggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaa

SEQ ID NO: 888 - DNA, 3334 bp, Homo sapiens
  ENST00000312033
ggctgggcgcttcctgccgaggcgaggcggcctcaaccacggcaggggcggggagaggtggggagcgatgctggtctgtgagcagcagcttgggctggcagaacggcctggaggtgggccagggcgcaatggagacagggggctccctgggtttggaacaaagaattcacaggcaggtcccctgaaactgggtcggcaggacggtggtggagcccgagagagggcacaggcaggatggccgatgctgacaggaaccagcggtgactctggggcccctggcagcagctctgtctcctgaagatgaagtggcccaggtgaagcccaggccagccccaatggccagctcggagactgagatccgctgggctgagcctggcctggggaagggcccccagcggcggcgctgggcctgggccgaggacaagagggatgtggatagaagtagttcacaaagctgggaagaagagagactctttcccaatgccaccagccccgagctcctagaggacttccgcctggcccagcagcacctgccgcccctggagtgggacccacacccgcagcccgatgggcatcaggattccgagtcaggagagacttcgggagaagaggctgaagcagaggatgtggacagcccagcaagttcccatgagcctcttgcctggctcccccagcagggccgtcagctggacatgactgaagaggagccagatgggaccctcggaagtctggaggttgaggaggctggagagagctcctcaaggttggggtatgaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtggagtcctttgaaagactgatacaggcaggacgtctcatgccccaggaccaagtcaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggagtaagtcactgagcctttcctgcagaatgtttgtttccaccctaaaaccacagggatgatcactgtcagagtgaataagacagcgcttcacagtttagacatggcttacctgtcctgcctcttcaagtgtggaatgtataccactgatagcccttgaaatgattttgggtagtgtgggacatgattttcagtaggacacatgcagtattaaagaacattattctcagctgggcacagtggctcatgcctgtaatcccagcattgagggaggccaaggcaggtggatcacttgagtccaggagttcaagactagcctgagcaaaacggcaaagccccatctcaacaagaaatacaaaaattagccaggcatggtggtacacgcctatagccctagctatttgggaggctgaagcaggtgaatctcttgagcccaggaggcggaggttgcagtgagctgagatcgggccactgcactccagcctgggtgatagtgtgagaccctgtctc

SEQ ID NO: 889 - DNA, 7380 bp, Homo sapiens
  ENST00000307564
gcaactgaagacggaggtgcccaaggtcagaaggaagcaccacacagagggcacaggcaggatggccgatgctgacaggaaccagcggtgactctggggcccctggcagcagctctgtctcctgaagatgaagtggcccaggtgaagcccaggccagccccaatggccagctcggagactgagatccgctgggctgagcctggcctggggaagggcccccagcggcggcgctgggcctgggccgaggacaagagggatgtggatagaagtagttcacaaagctgggaagaagagagactctttcccaatgccaccagccccgagctcctagaggacttccgcctggcccagcagcacctgccgcccctggagtgggacccacacccgcagcccgatgggcatcaggattccgagtcaggagagacttcgggagaagaggctgaagcagaggatgtggacagcccagcaagttcccatgagcctcttgcctggctcccccagcagggccgtcagctggacatgactgaagaggagccagatgggaccctcggaagtctggaggttgaggaggctggagagagctcctcaaggttggggtatgaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtggagtcctttgaaagactgatacaggcaggacgtctcatgccccaggaccaagtcaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggaggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatggcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagaccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcatcttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcgtttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatcttaaaaaaagaaaagaagacaaaaaaaatacccaaagccatccgtgtctctgctgtatgtcattaacttttgccttcaatgtcaagtttatggggtggtaggtttgatgcccagccaagccctttcccaggggacctgttgggtgctctgcctgcctccctctggtggcttctgtttctccagttttccccctttgcctatctcagaaccataaatctttcaactgcggagggccttgaggtggggctgcctagccaagtcccttttgactgaggccagagatgtaaatgaggcacacagcaagttgctgtctacaagagtatgcacctggactctccagtgctcctttctttcttttttttttcttttttctttttctttttttttttttttttgagactgagttttgctctggttgcccaggctggggtacagtggtggaatctcggctcactgcaacctccgcctcccgggttcaagtgattctcttgcctcagcctcccgagtagctgggattacaggcatgcaccaccacgtctggctaattttgtatttttagtagagacagggtttctccatgttggtcgggctgatcttgcactcccagcctcaggtgatccacccacctcagcctcccaaattgctgggattacaggcgtgagccatggcgcccagccttccagtactttcagtagcaaacagcacctgccatttagggagcacctgctagaccctgattccggtgctaagcactgggcattgtctgcttcacacagtccatgtgctaaccctcaggaccctcactctgccccccttttactgatgaggagagtggggttccaatgggccatctgcccaaactggtttgggagagaacctggatttaaactcacattggtctgacccaaagtccacattctttgttatgtgtgttttttgcttcctctacctccatgattctttttctcttgacctctggtttcttcctcacgtggctttttcttccatgttccccacttctcgtctcccttgcttctccctgctctgcccatcatgactcatttctgtttcatttttcagcggatcctcctgagtatggttgaaaatggtgtctcactgaaagtaacactgaaatggacaaacttcctgtaggttctgagccttcagttccaggacattgtgggaccccagaggctgtcctgtccacttgccttctgaggacatcagctcggtgtccccagcctccgtgctgtgggcacagctgtggtttgggtgctgagcaaaggatgctgtagtcttggccctgtggagcttggctgttgggacaggaggtacaaaggggagtggtgcctgtggacacaggactagaccccaggacatcagggcctcgggctcatggtcctatcaccctggatggtatacgcagctgcacacgtggaattgctcaaacaattcaggcccaacttttctgccacggaaggggtgctgcttccctcacgtaacaagaggctgtcaatcacgagcacccaggttggggtgaggccggccctttgtggcttgtgccactgagtgggctgtgcctcgggcttggctccacctcagggctccacatttgcaggatgtcagctgatttccagggaccagcctcacccttacgtgttatctccttcttctgggtctcccaggtgagcaccctaagaacacatccatggagacacccagcccctctggcctgggccccaagccctctgcatcaccccagcccttccctgccctgccctgtcctggcccaggcaaccgcctcttgcctagttgcccacagcagccttcactcaggccttcctgcctccagcctggtccccacaacgtgcctcccccgatggccatggtaatactggaataaggtccttgtgataggcaccacatgcctgaactctccccaccccatccaccttgtatttgtctgttctcacattgctataaagaactacctgagactgggtagtttatg

SEQ ID NO: 890 - DNA, 2138 bp, Homo sapiens
  ENST00000374079
ctggggcacagccaggaagaggcctccactccttctgacacagtcatctgagcgctcatgtctgctggaggcggcaccaggggatactcacccaggagtccaggggccaccagccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcatcttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcgtttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatcttaaaaaaagaaaagaagacaaaaaaaatacccaaagcc

SEQ ID NO: 891 - DNA, 2637 bp, Homo sapiens
  ENST00000477661
ttttcttaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaaggtaggcagcttgtgtgatcaaattaatttcacttttgttctcagcataaatattgtttttatggatatttgaactaagcattttcttaggaggacatagggattataacatagaagaagaatcctaaatctaactcctaattcctttctatgggatacattttgaatccatacttccgtgattgcatgtctataagaaaagaaagtgcagaactctcaaagcctctgcctcaaaaacttgaggaaatgatagtcatctccttgaaggcacaaggtcttagttatgattcctgatttcacctcttgggatgttcacagacacagagtttcatgaagctgtggtgtccagaaaacctgctgcacatagggtgcacaatgagtttccatcttcttgcctctttttaaggggcgagaactcagtccgggagtgtcttaaactacagaccttcatgggaaaccttgttgcttctgcttcctctcttttcacactggaggttttatttttgcttagccatgaattcttgggtcattcataacttttgtcttaaggtactgaaaactagtcaggctagttaatgcaaaagggtatattagatatgataatgggaaatcaaagccagggctacattaagaatttgataaaaactctaaaaatatatcctttctccacccttatctctgctttattacaaaaggctttttaagtatttgttccaacctttttcgttggtggcatttatggctttggagcactgtcaggcccatgttcattaccgtgagctcctgtgcatctcctaatttccaaactagccttgaaaacacctccattgaccatgattggttcatggtcctgtgcatggaacatcatatgttcagggagataaagaactctgatagtggcacctgggtaaaaagtacaatccattatatctggatatcaagatcttttgcagttgaagagaggtattgccacagagaaaattataggagcagaagaaagtcaatgaaagtcaatgatgacactccattaggaaccagaaagaggtatttatttatacatgtaatagttgtaagagattagagggagcctgtcacctgaagacattccttataccttcatatgtagtacactctgtacataccactctctggagcactgcatcacctacctcatggaggattagtgtccttaaatgtacctcagagcatggctatgtgtggagaaattgacttgtgacatcactaaactgactgcttctacttcagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcct

SEQ ID NO: 892 - DNA, 6705 bp, Homo sapiens
  ENST00000380872
ttttcttaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctactttggtctccataacttctatgttttctttccttctgacacactagtgcccctaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggttagggagatgggagggcaccaggaaaagtgattagaagtcaggtatgggaaggctaaataggacagagtcgagtacatctctgcttggaaaaacatatcaacacccttttttttgaacattatatcttgctcataaaagaaaactttccacattgttttaacaaaccccacagctgagagtcaggcctgaatctttgatgtgtgcccattcacaacgttgaccctattggtttgtggtggggcagggcatcaaagacatcattgactaatcacattcccctgaatagctcatatttagaaaatattcttagattctaaaaatgtactattaatttgtgatattcagtcttttaaatattttatacattaaacaggcatagttacaaatataaaacaaaaatatcccaaagccattatgcatggcactcaagattaaaatgggaaataatacatctaataaatcaaatgttccaagacttcaaaggtcttttggaaacaggctatgtaaaacagcacactggtttcaaactttggtaaattttaagaacaactcttacaaaggcatttaattcttatacataattttcaggggacctaagttaatcagctaatcatgaagacatgattttcattttagaaaacacttttgaaaacttgggataatctcatgccttaatgatcaaagcattatgagaaggacagtggtttttaacctgggcatatgttctaacacatttactctccactattcgtactctggtagccatgttaaccccatcagagattccttctcaagccatgtctcagagctgagaggcatcccagcaagttttgcagctcacagttttttccgtaaattacttattctataaaattggagtaggccataaactttggagggccctagaccaattttttggattatttttcgtcttctatcattccgctgatcttagatattctctgcattaaatattaaatatcacttctaggctgaaaaatccccctaaaaatatttctagctcagatttttcctccaaattctgcaatagaagatcacaatgtgaactctgcatctccatgttaaagtctaatggacattcacacttagcatgtctcaaagaaatctcatgtaaaccatggccatcctgttctaccttaactttctgagtctatggaatgataatttcacatctcataaacttgactgatgtaagtgtcaagaaaagattgacattttgttaaaagttagtagtgaagtgtgtaacgcttaagcaaactttcatatttcaaatctctttagcaagtgtaactcttttttcaagatgtgaaataatcattaggtcagtcatttgtaaatagtacatctgctatggactttttccagttcttcaccatccatttttataaaactcttattgttaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaattttggattctactcattattttacttcaatttaagatataaatgtatagaaataagtataattctaagctaatacgtatgcaatgtaggaagctgtaattactgaccaaaactatgtgaagtggagaaaacctggggaagtggatggttttagatgaaactgaagttaaattcatattgatttaaagtaaattgttataactttataaagtttttcatcatcaccacagcaatcacaaagagaataattatgaatatacgcaagaggaaatgagaagggaatccaaatgtcattaaaaaaaaatcacgccacctcacaaaatggtaacagtggatataaaggatagaaagctataaacctggtaggaaaacattgaaaatggcacaagtgactccttccctgtcaccaatgacagtcatgtgttgcataatgcctgggctatcttctgagaatggctttgttaggcaactgtgtcatggtggggacatgatagcattagagagaattctctcaaacactgtcatggccttatcaactatgcttctgtaatattctgaatccttcgctgcctttccaacagtgtttacaacggtttcctaagaaatgaaatccatttcaccaaaccacttttcttgctcatccataagaaacacttctcctttgttaaaattacatcatgagattgcaagcattcagtaacttgcaagctccaatttgaattctagttgtcttgctatttccaccacatctgcaattactttctccactgaaatcttgcattcctccaagtcatccaggagggttgaattcacttctttcaaactcctgttcaagtaaatgttttgccctcctgtcacgaatcatgaatgtttttaatggcatctagaatagtaaatctttttcagaagattttcaattttcttttcccaggttcttcagacaagtcaccatggtagctgtagacttatgaaatgtatttcctgaaccataaaacaagaacatcaaaattactctatgatccatgggaaacagaatgcatgttgtgttagcaggcatggaaagaacagtaatctctttcaacctctgtaagagagttcttggttgattaggtaccttgtcgataggcagttctaatttcaaagaactttttcttttgctgagcagtaagtcttaacagtgggcttaaaatattcagtaaaccattatttaaggagatgtggcttaaatatctaggctttcttgctttatttatagaacacttacagagtagatatagattaaatcttaaggaccctaggattgttagaatagtaaatgaacatcatatgttgtaatatagttagccagggaggggaaagatctctacaagaaataattttaaaaactactcaaagaaatcagagatatcacaaaatgacaaaacaagtacaggggcagcaaaaggtaacagatgtcaactatgagatctcatcaagaactaagaaaatggagaaaagtaccagatggcagatgggaggcagtgtgagcatgcctctcccacttggagattagtgtgtagagatttacattgtgaatttcttttcaagaaccaatgcagagacttaacagatatatgaaaaaatttcacatacactctgaagaagtctcaggcacaatcctactccatgaaataagaaaaaaccatcacatccccagattctgaggggagagagttcactccagagcatacatccccactggggatctggaaattcaggccacaagagaaggctttgatcctgtgcggacaagtgccttgagcagaatccacaggggagagctggaagtgcatggcagatatgagcacagaagctgggtgtccagccttgtgggcagaccgggagggatgtggcctgaaagccatggttattatctcagcgtgtaagctgatgatctgaggctggtcagagttctgtgcgcagactgcctggatgtaaacctggcactgttagcagagcactgcatgaatgaaaggaatgaaaatagccttgccaactgcataggtgctgggtgaggctcactgtggggggcgcacggcaagctattcaacattacgtacaggcatttgaggtcggggcatggaaaaatactgaggcagtgtgtgtatgttatttgtgctgagaatgaaactccttgaccttgaaaacaggacagggagtggtgtgtgtgctgtgataaggaatgctgaaaacggtctcctgagaatgcggtttgagtgcttttacaaggccacaggtgtctcacgacctgacctcataaagccatctagtggatgtttgtggcttaacaagccccttcaataagtacttggcggagggatgctggggggaccttcttagaagagctgcgccccacccccctccctggacagcccagctacaattgtctgagaactcactgcaagctgtaagcggcccactacttcccactcccttttttgaactcttctgtgcagcagaggcaattaaactctcctctggaacattaccccagcagcctgagaaccaccccttggcgctcacaggggctgcagcctgccttatccaaggacagttagagtgcagacccacctaaccctggacccactggtggtacccatccacccatcctggtagcttaacacaaagatacacttttaggagcttcatagcccctcttcccccattgcctgagaaaccactttccctgggcaacttagggcaagctcaaatcccactgctaccaccacagctggtgctcttttgcaagtgccacctcctagctggagaccaaccagcacagtccacacagcacctcaaggaagaataaatagaactgttcccaggaaggagaaaatgcctgcatgagctcagctgttaccactgcgtaccacaccctgaccagtcagaggtcttgagtcggtccgcatgacaagttcaccgctcgcataaccagcattcaagaaagccagcacactaagcctatctacagccagggagtctcagagtctacgtcactcccctgccacctcaatcagagctggtgctggtatccactgctgggagacttgtgctgaggtgaagcctgggctggatggctggaggatgaagaactgcacggaggagatggaggcacccagacagatgccccatggacatcctgaagcagagctgcctcactgccctgcacacacatgagagcgcagccaggaacagaaggactgggcaacattcaggcggagcccaggccaattttctaaacatggaatatgagttaaataaatggcttcgtattaaa

SEQ ID NO: 893 - DNA, 744 bp, Homo sapiens
  ENST00000442997
attcgaaatatcagtgtgtgaagctgaatgatggtcacttcatgcctgtcctgggatttggcacctatgcgcctgcagaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgc

SEQ ID NO: 894 - DNA, 858 bp, Homo sapiens
  ENST00000380859
tgaagattgattgcaatgggagtggtttctctgtttctttgtatagtcgaacagatatttacttcttccaagaagatacaattcagaggaatttttatggcaaaagttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtgattccaggcctccttgatcaaattgactgtccccaaatgttacacacatttcagcattaaagttactacacttttcccagtaaattacatttttttgttttattttatgttttaaaacttagagtcaatcagtgaagatctacagtggaaatacatatgtataaaattagtgaatttggtataatgatacggtgctgtgataatttaataaaagcattgagaaatt

SEQ ID NO: 895 - DNA, 713 bp, Homo sapiens
  ENST00000476100
cctgatctcatgatccgcccagctcggcctcccaaagtgctgggattacaggtgtgagccgccacgcctggccattccttgtgttaattttaccatactaaaaataattaagattatatctataactataggttgcatcctgttaatttttccaaaaaatgactgaacctgaaattgttttggggacacttccaaactagtggtcaagcagtgatttttctgggactgcagaagttcctgctgtgcccaacctttattactaactgggaaagacccagggagactgggatgggctcatgattctacatacagaactcatccaagaaaggaggaaaagctgatttttgtgaacgtcgctacttgtgcctgaactaactctcaggcacattagtcagaaaatactacctatggttactcccccaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaaggtagg

SEQ ID NO: 896 - DNA, 3756 bp, Homo sapiens
  ENST00000380753
ttttcttaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacctactttggtctccataacttctatgttttctctccttctgacacactagtgcccccaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggttagggagatgggagggcaccaggaaaagtgattagaagtcaggtatgggaaggctaaataggacagagtcgagtacatctctgcttggaaaaacatatcaacacccttttttttgatcattatatcttgttcataaaagaaaactttccacattgttttaacaaaccccacagctgagagtcaggcctgaatctttgatgtgtgcccattcacaacgttgaccctattggtttgtggtggggcaggacatcgaagatatcattgactcatcacattcccctgaatagctcatatttagaaaatattcttagattgtaaaaatgtactgttcatttgttatatgcaatcttttaaatgttttatactttaaacaaggcatagttacaagtataaaacataaatatcccaaagccattatgcatggcactcaagattaaaatgggaaataatacatctaataaatcaaatgttccaagacttcaaatgtcttttggaaacaggctatgtaaaacagcacactggtttcaaactttggtaaattttaagaagaactcttacaaaggcatttaattcttatacataattttcaggggaactaatcaaatcagctaatcatgaagacatgattttcgttttagaaaacacttttgaaaacttgggataatctcatgtcttaatgatcaaagcattatgagaaggacagtggttttttacctgggcacactttctaacacatttactctccactattcgtactctggtagccatgttaaccccatcagagattccttctcaagccatgtctcagagctgataggcatcccagcaagttttgcagctcacaatttttctgtaaattacttattctataaaattggaagaggccataaactttggagggccctagaccaattttttggattatttctggtctactctcattccgttgatgatcttagatattctctgcattaaatatcacctctaggctgagaaatccaccaaaaaatatttctagctcagcgttttcctccaaatcttcaatggaagatcataatgtgaactctgcatctccatgttaaagtttaatggacattcacacttagcatgtctcaaagaaatctcatgtaaaccatggccatcctgttctaccttaactttctgagtctatggaatgataatttcacatctcataaacttgactgatgtaagtgtcaagaaaagattgacattttgttaaaacttcgtagccaagtgtgtaacgcttaagcagactttcatatttcaaatctctatagcacgtgtaactcttttttcaagatgtgaaataatcattaggtcagtcatttgtaaatagtacggctgctgtgggctttttccagttcttcaccatccatttttataaaactcttattgttaaaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaattttggattctactcattattttacttcaatttaagatataaatgtatagaaataagtataattctaagctaatacgtatgcaatgtaggaagctgtaattactgaccaaaactatgtgaagtggagaaaacctggggaagtggatggttttagatgaaactgaagttaaattcatattgatttaaagtaaattgtcataactttataaagtttttcatcatcaccacagcaatcacaaagagaataattatgaatatacgcaagaggaaatgagaagggaatccaaatgtcattaaaaaaaaatcacgccacctcacaaaatggtaacagtggatataaaggatagaaagctataaacctggtaggaaaacatt

SEQ ID NO: 897 - DNA, 1481 bp, Homo sapiens
  ENST00000421196
tttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacctactttggtctccataacttctatgttttctctccttctgacacactagtgcccccaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggtta

SEQ ID NO: 898 - DNA, 2639 bp, Homo sapiens
  ENST00000460124
ttttcttaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggtaggcagcttgtgtgatcaaattaatttcacttttgttctcagcataaatattgttttcatggagatttgaactaagctttttcttaggaggacatagggattttaacatggaagaagagccctaaacataactcctaattcctttctatggaacagaaagcaattttgaatccatacttccgtgattgcatgtctacaagaaaagagagtgcagaatcctcaaagcctctgcctcaaaaacttgaggaaatgacaatcatctccttgaaggcacaaggtcttatttatgattcctgatttcacctcttgggatgttcacagacacagagtttcatgaagctgtggtgtccagaaaacctgctgcacatagggtgcacaatgagtttccatcttcttgcctcttttcaaggggcaagaactcagtccgggaatgtcttaaactacaaaccttcatgggaaaccttgttgcttctgcttcctctcttttcacactggaggttttatttttgcttagccatgaattcttgtgtcattcataacttttgtcttaaggtactgaaaactagtcaggctagttaatgcaaaagggtatattagatatgataatgggaaatcaaagccagggctacattaagaatttgataaaaactctaaaaatatatcctttctccacccttatctctgctttattacaaaaggctttttaaatatttgttccaacctttttcgttggtggcatttatggctttggagcactgtcaggcccatgttcattaccgtgagctcctgtgcatctcctaatttccaaactagcctggaaaacgcctccattgaccatgattggttcatggtcctgtgcatggaacatcatatgttcagggagataaagaactctgatagtggcacctgggtaaaaagtacaatccattatatctggatatcaagatcttttgcagttgaagagaggtattgccacagagaaaattataggagcagaagaaagtcaatgaaagtcaatgatgacactccattaggaaccagaaagatggtatttatttatacatataataggtgtaagagattagaggaagcctgtcacctgaagacattccttataccttcatatgtagtacactttgtacataccactctctggagcgctgcatcacctacctcatggaggattagtgtccttaaatgtacctcagagcatggctatgtgtggagaaattgacttgtgacatcactaaactgactgcttctacttcagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcct

SEQ ID NO: 899 - DNA, 745 bp, Homo sapiens
  ENST00000604507
tctcctgccagccaagtgaagacatgcttacttccccttcaccttccttcatgatgacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 900 - DNA, 553 bp, Homo sapiens
  ENST00000604184
atttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaattcctttctatggaacagaaagcaattttgaatccatacttccgtgattgcatgtctacaagaaaagagagtgcagaatcctcaaagcctctgcctcaaaaacttga

SEQ ID NO: 901 - DNA, 600 bp, Homo sapiens
  ENST00000604428
ataatagaattctcatgagatctggttgtttgaaagtgtgtagcacctccaccttctctctctctctccctctccctctcctgccagccaagtgaagacatgcttacttccccttcaccttccttcatgatgtgggaagagtgctgcaacccagccctagccaacgccgcatgagagggagtgtgccgagggcttctgagaaggtttctctcacatctagaaagaagcgcttaagatgtggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttttaccattggaatgacatactgcatcctatagttataccatccactctgaaatcaatgtgaatttaacttcagttccatacagaaacttcttttccacagactcaggaatttcaagtgtgctatccctatgtgtattgattatatcttcatcctgctc

SEQ ID NO: 902 - DNA, 576 bp, Homo sapiens
  ENST00000604711
acatgcttacttccccttcaccttccttcatgatgtgggaagagtgctgcaacccagccctagccaacgccgcatgagagggagtgtgccgagggcttctgagaaggtttctctcacatctagaaagaagcgcttaagatgtggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttttaccattggaatgacatactgcatcctatagttataccatccactctgaaatcaatgtgaatttaacttcagttccatacagaaacttcttttccacagatggagtttaagcccaagctggagtgcgatggtgcaatcccaactcactgcaacctctgcctcccaggttcaagctattttcctggcttagcctccggagtagctggaattacagatgtgcgcccccatga

SEQ ID NO: 903 - DNA, 579 bp, Homo sapiens
  ENST00000603073
gattgtaagtttcctgaggcctccacagccatactttctgtacagcctgtggaactgtaatgtctaatgaaactacagggcactggagccttagaccctgccactttgttgacacctactgggcaaccaaaggaactagtacacaactgcctagtggttatagatcaagagtcttccaggcgaccagatctgaaggacacagccctccagggtggagactggatgctctttgtggacagaagcagcctagtcaccaacagaaggaggaatgctgtctaggctatagtgactctcttggaggtaatagctgcaagaactctcccaacagggacttctgtgcaaaaggctgagtaaattgcccttatgagagccttgcatctgtccaaagtgggaagagtgctgcaacccagccctagccaacgccgcatgagagggagtgtgccgagggcttctgagaaggtttctctcacatctagaaagaagcgcttaagatgtggcagcccctcttcttcaagtggctcttgtcctgttgccctgggagttctcaaattgctgcagcagcctccacccagcctgagg

SEQ ID NO: 904 - DNA, 460 bp, Homo sapiens
  ENST00000604439
cagcctagtcaccaacagaaggaggaatgctgtctaggctatagtgactctcttggaggtaatagctgcaagaactctcccaacagggacttctgtgcaaaaggctgagtaaattgcccttatgagagccttgcatctgtccaaaggccctggagaaatgcagagatgcaggtttaaccaggtccatcagggtgtccagtttcaatcactaactgctggaactgatcctcagacaagccaggactcaagtacaagcccacctacaaccagatgagcccttagggccactggggccatttctgactttgtgctcttcacatacttccttacattagaataatgtaattgttcagtatgttgtgctttaattttttaagaaaatgtcaaaggctagccatgacacggttatgtgtatttcttttaacttttccataaatattaaataatgtaattgttcaga

SEQ ID NO: 905 - DNA, 1098 bp, Homo sapiens
  ENST00000455190
gtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaattcctttctatggaacagaaagcaattttgaatccatacttccgtgattgcatgtctacaagaaaagagagtgcagaatcctcaaagcctctgcctcaaaaacttgaggaaatgacaatcatctccttgaaggcacaaggtcttatttatgattcctgatttcacctcttgggatgttcacagacacagagtttcatgaagctgtggtgtccagaaaacctgctgcacatagggtgcacaatgagtttccatcttcttgcctcttttcaaggggcaagaactcagtccgggaatgtcttaaactacaaaccttcatgggaaaccttgttgcttctgcttcctctcttttcacactggaggttttatttttgcttagccatgaattcttgtgtcattcataacttttgtcttaaggtactgaaaactagtcaggctagttaatgcaaaagggtatattagatatgataatgggaaatcaaagccagggctacattaagaa

SEQ ID NO: 906 - DNA, 859 bp, Homo sapiens
  ENST00000605781
ccaccctggcgatggctccctggtcctactttctctctcaaactggctttttctcattcctttgactccgccagacttcctcgcccccatgacctggtgttgtgtctgatcaccccaacattcctggctgcccaatgtggggcaatgaagaccccagtgaaggaatgctagagtgtgtgaaagtggaggacgcatcgtcaaaggacacctgaggacgtctcaaagaagctcggcgggagagctgagcgctcggaagaaccaaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatg

SEQ ID NO: 907 - DNA, 996 bp, Homo sapiens
  ENST00000470862
ccctggcgatggctccctggtcctactttctctctcaaactggctttttctcattcctttgactccgccagacttcctcgcccccatgacctggtgttgtgtctgatcaccccaacattcctggctgcccaatgtggggcaatgaagaccccagtgaaggaatgctagagtgtgtgaaagtggaggacgcatcgtcaaaggacacctgaggacgtctcaaagaagctcggcgggagagctgagcgctcggaagaaccaagaactaagatcagaattctttgaatcatcagaatcatctcttttgaaaaatcgattcatcaaatgaatcttcagccaacaactgttcaagaaggatgcaaatatcacagtgttagatgaactttctggttgacacctgacaggaagagcctctgtattggaccaccatgtttgtgctcactgtgtagtaacaaaccaacacaccaaaatagcgggagttgccactgacaaagagttgaatgatcaaatgacggccaaaggaggaggtgtgaattcaaaggcagcattactccccattttcttccctctcctgtgtctctcccctgaggcttctctgcaaaacatcactgcccagcttagcatctgtcctgggcactggtaataatgtggtaccattcatcctctcctagcatttgatcactcatcaggagccctcagccccatggggaagaggacagaagaagaaaccagttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcatt

SEQ ID NO: 908 - DNA, 795 bp, Homo sapiens
  ENST00000480822
cctggcgatggctccctggtcctactttctctctcaaactggctttttctcattcctttgactccgccagacttcctcgcccccatgacctggtgttgtgtctgatcaccccaacattcctggctgcccaatgtggggcaatgaagaccccagtgaaggaatgctagagtgtgtgaaagtggaggacgcatcgtcaaaggacacctgaggacgtctcaaagaagctcggcgggagagctgagcgctcggaagaaccaagaactaagatcagaattctttgaatcatcagaatcatctcttttgaaaaatcgattcatcaaatgaatcttcagccaacaactgttcaagaaggatgcaaatatcacagtgttagatgaactttctggttgacacctgacaggaagagcctctgtattggaccaccatgtttgtgctcactgtgtagtaacaaaccaacacaccaaaatagcgggagttgccactgacaaagagttgaatgatcaaatgacggccaaaggaggaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctcc

SEQ ID NO: 909 - DNA, 636 bp, Homo sapiens
  ENST00000602997
tgctagccagctgagtgacagtgatggattcaaaacatcagtgtttgaagctaaatgatggtcacttcatgcctgtcctgggatttggcacctatgcacctccagagaatcatctcttttgaaaaatcgattcatcaaatgaatcttcagccaacaactgttcaagaaggatgcaaatatcacaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaaca

SEQ ID NO: 910 - DNA, 972 bp, Homo sapiens
  ENST00000439082
atggattcaaaacatcagtgtttgaagctaaatgatggtcacttcatgcctgtcctgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaa

SEQ ID NO: 911 - DNA, 1405 bp, Homo sapiens
  ENST00000605149
tttttgctgaacattccccttagtaaaatggcaggatggtttgcttgccattgaaactaaccaaacatttaatccttttccctttagagaaaaaagaaaaaaaaaggtgcagctcactgccagtgcccatttagttttacattaacatgttccttgaggttgaagcaaatctgaccgattttcaatgtaaaaataacatataaaaactgttctcggagttatttctaaacagaactaagatcagaattctttgaatcatcagaatcatctcttttgaaaaatcgattcatcaaatgaatcttcagccaacaactgttcaagaaggatgcaaatatcacaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagggctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttg

SEQ ID NO: 912 - DNA, 1807 bp, Homo sapiens
  ENST00000380554
ccctcatcaggattacagctttatcaggactgcatcttcttcagaaatgaatatttctcttacaacgcaaagaaagaaaaatcaaaataaattttctgattgaaaatgtaaaaaggcaaatatttttacagttttaactttaattttttattgaggaccaactatttgaaaaattctcattagtcattcctttaaattatgtgtatgtgagagaaagacgtaagatggttaattatttcaaatgatgcagtataaagaaggggcattatcacggcagaaacgaaaaaagatatttgtagctggaggtttttatagtctaacatatggttgctatttgttctacaaatccttttgaataatttaatatagagatttagaatagaaaataatactttagatagaaattaatgagtttattataaccatatattataataatttacttaggaattctctttgataagaaacaaatgaactgaatgcaattttctccacagaccatataagactgcctatgtacctcctcctacatgccattggttaaccatcagtcagtttgcaggggtggggggaggggtttcctgcccattgtttttgtaatctctgaggagaagcagcagcaaacatttgctagtcagacaagtgacagggaatggattccaaacaccagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagggctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaataa

SEQ ID NO: 913 - DNA, 1026 bp, Homo sapiens
  ENST00000480697
aaacatttgctagtcagacaagtgacagggaatggattccaaacaccagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaaggtatgcagtttgtatgagcataaaattgcgcttctgctgtcattataaacattgtttatctggatagttgaacagagctttttattaggaggatgtagggattatcacacagaagaagaaccgtaagtggaacacctaatttcctttctttcgagtaaattttgaatcctacttctctaatgcacacctacaagagaagagagtacagcaacctcaaagcctcttcctcaaaaacttgaaattacaatagtctctttcaaggcactgtcttagttgtggcttttgagtccatctcttgggatgttcccagacacagagtttcatgcagttgtggtgcccaataaaactgctgcacatgtgatgcacaatgagtttccaccatctctccccatttcaagctgaagcagatttggtggaagccactatgcatggttcttaaattagaaacccttaatgtggacttgcaaagctttattattctgctgcctcttctttcacaatagagtttgaagctgtatttagccaggaattactgtgtagtgtataacttttgatttaaagttacagaaaactactcaggctagttaatgcaaaagagtttactgagttatgtaaaatgggaagtc

SEQ ID NO: 914 - DNA, 846 bp, Homo sapiens
  ENST00000605322
atttgctagtcagacaagtgacagggaatggattccaaacaccagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaaggccatggagaagtgtaaggatgcaggattggccaagtccattggggtgtcaaacttcaaccgcaggcagctggagatgatcctcaacaagccaggactcaagtacaagcctgtctgcaaccaggtgagctcccttggccttctctcctttcggttcttcatgccccctcttcctgtcctattgccaaatatctgtttgttttgtcccagttatctttgtgaagtagaagattatctagagagcaaagcttctgtcaagaaaggcgtgaagatttcttgtttgtaccctgcttggaaaagtattagggaaaaattggaatgagtttaatgctgaatcgtgtgtaatatttaggggaggtccatttgatcagggaggcctggaatcatcaattagaactcaaggaaaggtggacttacctctaagctatgaaagatgaccagaaagtgcatgggtgaaggtgatttggagggaatggtgtatagatatgaagctaggaaaagatgaaatgagctgtacgtgaacagagagttagaataagagaagagaggtgctaggggtttacatgga

SEQ ID NO: 915 - DNA, 528 bp, Homo sapiens
  ENST00000603312
cttttccaacaaatcactgaatctgagggtgttatttggtacctccataacagtgatcaaccagagattgcctgagactgaaggtgtttctgggatgctcaacctttattactaaccaggaaagactcaggcaaactgagatggacttttcaccccacatacagacaggaggaaaagctgattcttgtataaaagtcaatgcttgtgcctgaactacctctcagccacagtgatcaccagatactacctttggttgctcctccaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttat

SEQ ID NO: 916 - DNA, 629 bp, Homo sapiens
  ENST00000603484
aggtacatgaccctatcatgtgggcacaatgtgaccctatcatgtgggcacaatgtcagcgctgtttcttctccattttctgttgaaattttctctttgtctgcagagttgcacagtttcaatacataatatctaggaatggatttctgcttatttttcgtgagctattcattgacccacctgagtgtttagagctgacttctataactgtttaaaacttaccaatattttaagtattgtctctgcaccctactgtctaatatacttggggattcacaactggcaatctaaaaataataaaagttttttatttctgataggtttttgagttccagttgactgcagaggacatgaaagccatagatggcctagacagaaatctccactattttaacagtgatagttttgctagccaccctaattatccatattcagatgaatattaacatggagggctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaataa

SEQ ID NO: 917 - DNA, 808 bp, Homo sapiens
  ENST00000469875
taggaagaagtgaatagaagaaaagagggtgttgcaaatcaaaagcacatagagatatcatcttacaccagtcagaatggctattcttaaaatgtcagacaacaacagatattggattgccacatcatcaggaccacaccttcatcaggaatgaatattcctactacaattaaagaagaaacaaaattaatttgttggtgaaaaacgtaaaaagagaaattttctttggttttgtttaatttctttattgagggtcaccactaaaaaaaaatgctcactggtcattcttttgaatactgtctgagagaaagatgtaagatggttgattatttcaaatgacagaagataaagatgggatatcatcatggcatgaacaaaaacaagatttgtagctggaggtattttatagtctaacatgatcaccaatcattctataaacctgttggatgagtttatcagacagacagagagagagattgattgattctgaatagaaaatttcactttagaaaaaaatattttgactatataataatgtatgtaaaaattctctttgataagaaacgagtgaactggattcaattttcctcacagcctgtgtaatacaccatcacttgcttcctcctacatgccattgattagccccagggagcagtgcagcactgcctgcccatgttttacataacccctgaatataaatgccagatgttgctgaaggaaacaggatctgcttagtgaaagaagtggcaagcaatggatcccaaatatcagcgtgtagagctaaatgatggtcacttcatgcccgtat

SEQ ID NO: 918 - DNA, 1414 bp, Homo sapiens
  ENST00000380448
aggaagaagtgaatagaagaaaagagggtgttgcaaatcaaaagcacatagagatatcatcttacaccagtcagaatggctattcttaaaatgtcagacaacaacagatattggattgccacatcatcaggaccacaccttcatcaggaatgaatattcctactacaattaaagaagaaacaaaattaatttgttggtgaaaaacatgttgctgaaggaaacaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacagcctctggttaaatccctcccctcctgcttggcaacttcagctagctagatatatccatggtccagaaagcaaacataataaatttttatcttgaagtaa

SEQ ID NO: 919 - DNA, 1192 bp, Homo sapiens
  ENST00000263126
acaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacagcctctggttaaatccctcccctcctgcttggcaacttcagctagctagatatatccatggtccagaaagcaaacataataaatttttatcttgaagt

SEQ ID NO: 920 - DNA, 1936 bp, Homo sapiens
  ENST00000396198
acctgtcattcgttcgtcctcagtgcagggcaacagggcccacatgccttggccccacataccaacccaggctgctgtgacagcccatgagagggggagaggttgctctgggatggaacaagaaaaagaggttgttttgtgaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagca

SEQ ID NO: 921 - DNA, 2027 bp, Homo sapiens
  ENST00000330807
aatgcagggccaggccggcagaaggcagggtgggtggggctgagtcagaggagaagggataaatgccaggtcctaacccaagtacccacctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagca

SEQ ID NO: 922 - DNA, 1795 bp, Homo sapiens
  ENST00000335854
acctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctg

SEQ ID NO: 923 - DNA, 959 bp, Homo sapiens
  ENST00000498636
tggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttc

SEQ ID NO: 924 - DNA, 646 bp, Homo sapiens
  ENST00000463868
acctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacagggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacct

SEQ ID NO: 925 - DNA, 582 bp, Homo sapiens
  ENST00000477869
acctgtcattcgttcgtcctcagtgcagggcaacagattctccatcttgggcgaagggccactgtcccttcatgctgtcggaactccaggatgggaagagcaagattgtgcagaaggcagccccagaagtccaggaagatgtgaaggctttcaagacaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttact

SEQ ID NO: 926 - DNA, 664 bp, Homo sapiens
  ENST00000455688
acctgtcattcgttcgtcctcagtgcagggcaacagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggc

SEQ ID NO: 927 - DNA, 658 bp, Homo sapiens
  ENST00000493869
acctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttg

SEQ ID NO: 928 - DNA, 4701 bp, Homo sapiens
  ENST00000306107
agagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagctatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttca

SEQ ID NO: 929 - DNA, 1770 bp, Homo sapiens
  ENST00000470756
cggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcagtaagtagtctgcagcagtgtcactgctaagtgggattgatggccagtaccagaccatgttctttagaaagaagactgaactctctgtagtgtctctatagcaggtatctatataaggggacttaaagagatcttcattctgctcatatatactatcagcaaagaaaacaaagagtatgaaattcaaataggagatttgcagtgaggaactaaaataatattctctgttactttgtcatgtaaaaatgtcgtgagctatgaagtactactactgataactagcaggtgatcttaatttttactgacatgtacaaataagtgttgtgtgatacatacatagatatatgatatatatgtaatcatgtatatcacgcatacatatacatgtatttggctgaaccaaatgaaattgccattttgctgcataataaaaaaatataagcaaattcaaactatattttaacagaggtataaattttccatttatatatatccacatatataaatatcccatatatatccacatacaaatattttatatattatatatattagagatatagatacatttccatcctgacctttattgactggttattgatttagatttcaaaaagtattcacttgctttagaaaattgtcctaaaattaaaaaaactcactataccctgaatgcttatgtgggatacaccaaggggagaaagtagagtagtgatggaagaagagaaaattgtagaagaaacttggaataattatagtcactatgacaaaattactttgcctaatgatagcatatagttaatgttactgtgcaaataactgtgcaaatgaatgacttgagaagttataattaaagtatttcatcttttaaaactcaaataaaaa

SEQ ID NO: 930 - DNA, 4189 bp, Homo sapiens
  ENST00000472644
gcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagctatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctaatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccg

SEQ ID NO: 931 - DNA, 1242 bp, Homo sapiens
  ENST00000481337
agtcattatttgaatggtttgtgcaattgacatatgcctcagtttttgtttttgttttttaaccaataagcatggaaaaaaaaaacctcctatgttagtttcttatttttcatatatagaaagtcatatggaatactcctgctatatggctatctctgatcttctgccccaggatatatttttcaggcattgaaggactgatgccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagctatcacagttcactagttagcactttgaacagattttctgcttcacagatttggatttgtccttaaacccaagtggagaagtgactagacagattggtgatgccctacccgtgtcatgcacaatatctgctagcag

SEQ ID NO: 932 - DNA, 1818 bp, Homo sapiens
  ENST00000486979
aaaccctaaagcccagtgcttttagtgacatttcaaatgccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagctatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaa

SEQ ID NO: 933 - DNA, 564 bp, Homo sapiens
  ENST00000460954
ttaatcaattgctcctgaagtctttattaaaatttatgtttcttagaactacctatatttaaaatgtttttgtccatcatctcaggttccacatttgaaagattttctcacatttacactttcatattgtgacttggcttaagagagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgctta

SEQ ID NO: 934 - DNA, 2496 bp, Homo sapiens
  ENST00000465413
gttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatg

SEQ ID NO: 935 - DNA, 2845 bp, Homo sapiens
  ENST00000491388
ttgggacttagtagctgtacaataaatacttgttcagttgagttggaattttctcatacagatcagactatgacagtaagatttttataaagattgttttccatcaactggatgagaaatggaatagcactttttaaaaatatctgctgctatagtaaattctctctgaagaaacacaactactatctcatggtttttcaatttatcacctgctgtctaaagatgcttgattttccaacatttatgccttactgtctctttatataatatttacctagtcatcatctttattttcttccagaagtgacttaagatttttttttcttaaggtgataggccctaggggaatatttatatcccctcaaaatatcaatcacgttaactgcaaataaatggataatcaattagattgaccactctcttgtctaaactagtctcaaggctggcttgaaaaactaggctaatcatgctatagtccaattattttagtcatataaatcagttctgaatgttcaaatgcagttagaagaaatttattttctttcatcttttcttctccaaaatattttgactatcttacatttcagagttagcactttgaacagattttctgcttcacagatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatg

SEQ ID NO: 936 - DNA, 783 bp, Homo sapiens
  ENST00000489178
caactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagtgagttgtggaaaaaagatcttcatcgttcattgactttcactgggagaaaatacaatgtgctaattttgctcactccagtcgtgcatataatttatacaataaggaagatgtatccccaaatcaggttgattatatattttgtttcaactaattttgactacactgcctttgtcagggacatggcttgggatactgtttcacatgtgtccgtttatttgtctcaatcaatagcctgaattcaattatttgattttttcagtgcttgagtgaattttttaaagcgtatacttcctaaaggtcaacaaccatagactttttggttgaagttggagaagattcattaaaagtacctagtacatcttgtagggactgccaggtgtctttgcagtgacacatctggccagcaatgaaactgctgctgaggtaggaatatcttattgttattactcccatattctagttagttgactttgatccatataagagtctatatcagagaaaatcatgtcattatgtcaacttgagtttttaaaaatggattaaagtaccaacactacattaaaaatgctttagagatgttaaa

SEQ ID NO: 937 - DNA, 2107 bp, Homo sapiens
  ENST00000297785
ctatcagaaccaaattgctgagccagtcacctgtgttccaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgtta

SEQ ID NO: 938 - DNA, 822 bp, Homo sapiens
  ENST00000376939
tctatcagaaccaaattgctgagccagtcacctgtgttccaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatggggccagtgttgtatagccgcatccaggatttttgtggaagaatcaatttatgatgagtttgttcgaaggagtgttgagcgggctaagaa

SEQ ID NO: 939 - DNA, 879 bp, Homo sapiens
  ENST00000482210
caccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggtaatattatttactcagggcaaaagttaagaatgtctgcattgccagctatgaagtatgttttatgtaactatttttgagccaacaattttaaaacaaaaactctttttaatgatttgttacttattttagccttcaaacatatggatagaatataagcagatgtagtt

SEQ ID NO: 940 - DNA, 806 bp, Homo sapiens
  ENST00000419959
agaagtccaggatgggaagagagatctgcagactcccagggaacctacagctttctccttcacagcattgcaggaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatat

SEQ ID NO: 941 - DNA, 805 bp, Homo sapiens
  ENST00000446946
gtggccaggatcgggtctgggaagctcggagatttcactgtgagtggagtcagagggaaggcatttggagcaaaggcttctgtaagagggagtaggatggaaattgatctttgaagaaagcaagacagaagaagggagatggaaagatgaaatcattttaaaattgctggtaacaaacgaaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctc

SEQ ID NO: 942 - DNA, 604 bp, Homo sapiens
  ENST00000493113
ctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattcctgtaagcttttctcctatataattctcaattttaaaaagaagagttcttattctatctaatgatgaagctttctctaaaacagatggatgcttatgtatttgttaaatgtggagtaaatgtaagatttgttgaa

SEQ ID NO: 943 - DNA, 209 bp, Homo sapiens
  ENST00000493311
cagctttctccttcacagcattgcaggagcttgcagcctgaaacatcagtcagatgagatcttgggtgaagagaaaagactgtataacatatttactgtctgctgagtgcataagaatgcagtctctgccagtcactggagacatcaagccctgaccactacaggaagcacatggtttccattacataaaatttacacatttggatttg

SEQ ID NO: 944 - DNA, 2107 bp, Homo sapiens; identical to SEQ ID NO: 937
  ENST00000297785

SEQ ID NO: 945 - DNA, 822 bp, Homo sapiens; identical to SEQ ID NO: 938
  ENST00000376939

SEQ ID NO: 946 - DNA, 879 bp, Homo sapiens; identical to SEQ ID NO: 939
  ENST00000482210

SEQ ID NO: 947 - DNA, 806 bp, Homo sapiens; identical to SEQ ID NO: 940
  ENST00000419959

SEQ ID NO: 948 - DNA, 805 bp, Homo sapiens; identical to SEQ ID NO: 941
  ENST00000446946

SEQ ID NO: 949 - DNA, 604 bp, Homo sapiens; identical to SEQ ID NO: 942
  ENST00000493113

SEQ ID NO: 950 - DNA, 209 bp, Homo sapiens; identical to SEQ ID NO: 943
  ENST00000493311

SEQ ID NO: 951 - DNA, 571 bp, Homo sapiens
  ENST00000561338
gacaaagtctatggctgagtgctccagtctgatctcaggctcccaggatcacgtgggtatcaaacggaggagctgcaggtgagccagtcggcatctttgcaactggctcctgagaccagacgcctcgggtcacaaggatgtctgagtgtgagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccctggagacgatggatacagggaagccatttcttcatgcttttttcatcgacctggagggctgtattagaaccctcagatactttgcagggtgggcagacaaaatccagggcaagaccatccccacagatgacaacgtcgtgtgcttcaccaggcatgagcccattggtgt

SEQ ID NO: 952 - DNA, 3924 bp, Homo sapiens
  ENST00000329841
attcccgagcgccgcgagccggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccctggagacgatggatacagggaagccatttcttcatgcttttttcatcgacctggagggctgtattagaaccctcagatactttgcagggtgggcagacaaaatccagggcaagaccatccccacagatgacaacgtcgtgtgcttcaccaggcatgagcccattggtgtctgtggggccatcactccatggaacttccccctgctgatgctggtgtggaagctggcacccgccctctgctgtgggaacaccatggtcctgaagcctgcggagcagacacctctcaccgccctttatctcggctctctgatcaaagaggccgggttccctccaggagtggtgaacattgtgccaggattcgggcccacagtgggagcagcaatttcttctcaccctcagatcaacaagatcgccttcaccggctccacagaggttggaaaactggttaaagaagctgcgtcccggagcaatctgaagcgggtgacgctggagctgggggggaagaacccctgcatcgtgtgtgcggacgctgacttggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatggcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaa

SEQ ID NO: 953 - DNA, 713 bp, Homo sapiens
  ENST00000558033
gggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccatgacaacgtcgtgtgcttcaccaggcatgagcccattggtgtctgtggggccatcactccatggaacttccccctgctgatgctggtgtggaagctggcacccgccctctgctgtgggaacaccatggtcctgaagcctgcggagcagacacctctcaccgccctttatctcggctctctgatcaaagaggccgggttccctccaggagtggtgaacattgtgccaggattcgggcccacagtgggagcagcaatttcttctcaccctcaga

SEQ ID NO: 954 - DNA, 1670 bp, Homo sapiens
  ENST00000557963
gcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaaggtgaggcgggcgcccctcccacccgacggccgcgggcccctgcgctgggcagccagactcggggcggcgggggcgagggagcagcgggccgggggtccgccgggcgccgccgagacccgagcctccctgcccgggcgcggctctccagaaaccgcacctttcgcgggacgtctcgggcgggatcgcaggcggcggggctcggcgctgtgagcctcgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtccgggaggcagatggcggagctgcagttggaagactggggaagcgggtcctccgagcaaagcgcagcgggcgccttccgtgcttagtttatacccggctcagcagcagaacgaggaggagtaggaaggtgctcgcttactgacgaaacctccccggagcccagaggtcccggtgtttacacacaaggcgcgcgctccggaaggtcgcagacctgggcctttgggaagcggtgggtcgcgaggccgcagaagcgcacggttctctgcctcctcgctctgtgggctgggaggctacagcgttggcagaacggcgagattacctgcccggggcagaaaggaataaaagaagatggtgaggcctccgaggcctctgagctggggctgaggagggccgagagacccgggtccgggagcgcgacccgatggaggacacccccaggctgtctggcgtgcgcgtctgtcgtgggccggtgctggggcactttagaggcacaggccaggccgagagccattgccttaactttccccacctttggcttctcttgatttttgcttttacccatagcccccaactccagctgacaccgcacttagagaatttcctcatccgttttactttaagaagtagcaattatctttctcaaagaattttaatcaagcggagaaagttgcagggcactatgtgtggccttcagatttgggtctcttggcacttaattcccaatgtcggctgagcctctgatcacaagacatttaaattaactgttttcagaaggctctgtaatcaacaaagacacgtcgctgtaaactaaacgctggaaattattcttaatgtagttttatttgtaatatcagcttcagagtgaaaattccaacacgaattctgggaagagtgaaaatggtacccgaattttgtaagaccctaaccccaggtgcttggctgctgctactgatggttaagtggggaggttgtttgttttcttttggttgtacaggatttcaaaatactgtatatagaaaccagacagtaaatgtattatggtcctttta

SEQ ID NO: 955 - DNA, 576 bp, Homo sapiens
  ENST00000560555
ccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccggcagctcccactgcagccaccccagagccagctaaccttcagagagcttcctgggaacacacaagcacacacgactggccacacagcagaggccactgtgctacagatggaagatcagatgccagtgtgcgttccttcccagcacagctttaaatccgcctggcctccaa

SEQ ID NO: 956 - DNA, 3104 bp, Homo sapiens
  ENST00000346623
agggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccgggttccctccaggagtggtgaacattgtgccaggattcgggcccacagtgggagcagcaatttcttctcaccctcagatcaacaagatcgccttcaccggctccacagaggttggaaaactggttaaagaagctgcgtcccggagcaatctgaagcgggtgacgctggagctgggggggaagaacccctgcatcgtgtgtgcggacgctgacttggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatggcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaa

SEQ ID NO: 957 - DNA, 586 bp, Homo sapiens
  ENST00000558869
gtgatctgtgttctgtcctggaggttggaaaactggttaaagaagctgcgtcccggagcaatctgaagcgggtgacgctggagctgggggggaagaacccctgcatcgtgtgtgcggacgctgacttggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatct

SEQ ID NO: 958 - DNA, 3179 bp, Homo sapiens
  ENST00000273450
tctgcggcaccaggactgagtagaagggagagagtggagaaggggaattgcagagagaaaaccaggggctgtttttctctcggagaggcgggtaggcactgggcgggcagaagcgccgctatccacccggatgcgcagctgctaaggggccgcctctgcaagcggctgcaaattcccggagggcagcgtctcctttcgctctgctgtgtccgtagcacatggcaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagagac

SEQ ID NO: 959 - DNA, 3157 bp, Homo sapiens
  ENST00000472186
actgcgctcaagtggacggtcgcgcgtgcagagggaggccggatagcagaccccacaacgtggctcctggggccccgctatcgagagctcaggccccgcgggcacttgcctaggagaggaaagaatcttcccaaagtgcagacagagacggaatttaatcaggagtcccagacttggagtttggaggcatgggctctggtgtcaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagag

SEQ ID NO: 960 - DNA, 3670 bp, Homo sapiens
  ENST00000467370
aaaaaaaaaaaaaaagaagagcaaagcagagctctgagcagcttcctgccccagcatccctggttctgctgctttcttcttcccaggcagccgtgtcacacagacctgcagctgagatgggtgccatctccctgggttgcttctgcagaggaggcctctcctccccagtggagcctcctacctgccggctattgactgagtgtccagctgaggacagcatccctgcagtgcatttcttgcccactgatgtgatgtgttcatgactcccagcctctctgtttgctctgccactaatacaaggaggtgccccagcctctgggcccctgcagctgtgccagcggatggtgctgttttgtattccttaatttgtgcagcaccagctgcgtgcaggcactgtgcttggcaccggggctgtaataggacccagacagatgcgtgcctgccctggccaggctcatgctctgcaggtggggtcagaggtcaacatgcagtagaggaaaggacagcagatggggtgcacaggcaggctgtggttttatacggggcgatcagggaggcaccccagagaagggaacacaggcctgcaggaaatgaggtgtggagtgggcagcaggaagggcagtccagggggcagtggggcacaggcctggtgtgtacaggccagaaaggaaaggcaggtggccgtgtgaagccgcaaggggtgggggggagtggggaggcactggccgggtcttgcttcttgcagcaaagcatgctttgggcctacccaggtccctgccacctggggtcccaatgcccctacctgccctggagggaccggccccaccagccctctgttccttgcagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggtaacctactcctgcctgtggggttgctttcatttattcattcaacaaacatctgttcaaaaccacttagggccaggtcctatctcagatgcagggacgtagccttgaacatgatggctgtcagggttcgcttcttactgggagggaacttgtgacaagtccgtgagcaagatgcttgcagaggggggtcgtgctgggaagaaggcaagaagaggggcctggaggagacactccagccaggaggcactgggggcctctctggtgtggtggcacctgtgctacccagacctgcatagcagggaggagttggccatgaagacccaggggcccgtgtttctggctgagggttcagcaggtccttgggggaaccagctttggtcgtggagctgcagagaggccagagtggtgggagtgggccaagggggagcaggagggaggagagaaggcctgagaggcaggtaggggccagattgaaggcccatgggccatggtcaggggctcaggttgcatccttagtgtaaagaggagccatgggaccaaatgtacccccgggtgaacaccacgggtgttgcaagtctcccagtagaggtgaagttactcaggcggcagcaggcggggtccaccggcacatagcaggcggggtcccccggcacacagcacaggctccccagtgctctgcctgctgggtggcatggagttctgctccggccctctctccctgggctgctccaagccttgggcctcgtcctgctctctcagcaggggggactagacaggtctgatgggcaagcttggcaagggtggctggcaaggtccggggaagccatatgctgtctcagaggtcccacctgtctctccaggctcctgtgccagcccagagaccacagggaaggtcatgctgaggctgggggtcaaaggctggtcactgtttccagttttctctcctccccctgcccccatctttcaagccctgcagaagcccccaagggtacccatgagaggggcccatgtgtgcccacagggctggactcacatgcacgcatgtgtaggctggacactcctgcttcctctgtccctgtcggcctcctcttcctgccttctcccaggccaccttcctggtgtccaccaggggaatccatgaggcccatggccacccagggaaggctgtggctgccaagtccccaggacgtgatctgggccccttatgaatcctccccgagttccctcagctccctcctaaccctagtccccatgtcctgctgagaggaccagcaccctcctgggacaggcccacaagccaagccttccaagcagcctgcctgggcagactcaggacctcagagggacggggcagtgccactcctggggccagccagagctgctggggagctgtcaggcagccccaggcctcacacttgtcatggggctgagatgcaccagccacatagcactgccaaggcctggggcctcagggccctgcgaggcatccccttttcccagccacagcttgatgcagacgtagctgggggcagccatgagagaagagatgggccagtgagtctgggcagtaacgccaagtctctccacccccttccacctgaaggggcttcccactgtccagacaaggcggtgggagctggggaagattcttaaatggctgcctcagattggctttgtattctggggagtcctggcccactatccactgccagggataacctgggtaagattcatgacctcgctgggcctcgacttctcacctggaagtggggtgagccagagctgcccccacgtggttgctgaggaataagacacttgcagccccgagcagtgccctgcctgtggtgggagctgctgtgacctttgtggtgtcttacaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagag

SEQ ID NO: 961 - DNA, 2758 bp, Homo sapiens
  ENST00000452905
acaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagag

SEQ ID NO: 962 - DNA, 3277 bp, Homo sapiens
  ENST00000393434
acagtaagtcttcttgacctaagcgggaaagagcgcaggcccctgcggggttggcttttacatggcatttatagacccgcccggagagggtgcgctgcgctcccgccatagtcccaccaccggtgagcgccgcccccactcggctgactctccgcccgccccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagag

SEQ ID NO: 963 - DNA, 516 bp, Homo sapiens
  ENST00000462808
ggagccatttgggatttcagcctggaaggtggatttagagtcagaattcagaaagccctgaggctagaacagagtgtggactttccccaggggtcagccatgagagctgagtcaggtgaggatcattgtcagaaactgtggcagcacaagccacacctgacttggaggactttctgcaggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttca

SEQ ID NO: 964 - DNA, 4604 bp, Homo sapiens
  ENST00000476245
ggcagggcggctcagtcacctgggcagctggtactgctgagaggcagggtggcaggctatgggccggagcccacagctgcaggaggggcccggggatcatatgtgagggctgcttgcccctgcccgaggacaggctggcagggacggccacaggcagaggtgctgtccaggcatgcagcaggagggaaggaggccctggggagcccttgctgtttgggcgcagcaggaagagcagctgcagtgtccactgtcccctcgtcctcctcagctcctggccactgccttttatttttcggttgtgttaaacttgtcttccccacagattgaccagctcacaaaaatagtgaacaaagtagagttgctggagatttagtggtacagagagggagcttacctgtgcttcccacggcaagcaactcaaatactccttgaagctgcactgtccaacaaggcagccactggtaacatgcagctattaaatcaattaaaatgaattatactgaaaaattcagttcctcagtctcagccacattctaagtcccctggccaccgtgttggaccgtgcagacttggaactcatccatcaccacagagggctccattgggcagccctgcctcagatgctctgacacccggtcacttcccattcttggcacctcccggtctcttccctcaggctcttgctcacgtgggcccagactccttggctctccttctccctctctgattcctttcccaccaccttcctctttcctgtcacagagaaacaacttcctgcttcatctcagacctccaaacttccaccttcaagcccaccacggggctcaggacccactctctttaaaggcagagaaggcttagacagcaacatggacatttgtgtctgtgttatacctgcagggctttacagtttatataatcatctaagatatcagaagatgtaagatctatgtaatctaaacctttgccaggtagagaggacgggtctgtgtccgttgtgcaatagaagttaggttcacgctgactcccttgttcatatggcaggtgtttcttgggtgactgctgtgtaccaggcaagtctggtcagtctggggaagggtccaggctcaatgtgggccctggggctgggaaggaggcagggtcctattgctggggatagcaacccactggatctccccaggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatggttggagacaaggctggagcgcccagcacagcaccccttgtgggacaccttcatcactgcctcaggtccgaccacaggaactgtgaaatccttccttttggccgggcgcagtggctcatgcctgtaatcccagcactttgggaggccaaggtggatggatcatgaggtcaggagttcgagaccagcctgaccaatgtggtgaaaccccgtctctactaaaaatacaaacaaaaattagtcgggcatggtggtgcgcgcctgtaatcccagctattcaggagggctgaggcaggagaatcgcttcaacccgggaggcggaggttgtagtgagccgagatcgcaccactgcactccagcctgggcaacagagcaagactctgtctcaaaaaaagaaaagaaaagaaaagaaatccttccttttgcagctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttgggtgagttcctgcccagggcgaggtgcagcctcgcggtgctttccatgcagtacacggaactgtagcacagcctgcgggagctcacagcaccctgtgcgtgcatttatcaaacagccatccatgtgcttcttgagcacctgctccatgccaggcattgttgtaaggacttgaggacaattgtatttaatctcccagtaacactggatcagtcaggtccacggtgggaaacaagagtaaacccaaaaaatgtccaaaatgggtatggtggtcagtgttcataaagatgaggaactcctgcacagcactgaggaacaggaaatatagaacaaaggaggaacaggcagaggacgagagctgctcagcaggaggagttcggaccccgctggatgccaagcatgtaggcgccgggaaatgaacctggcgtgaggcacctcacctcgccacccagtggccccagggcaggagtagggagaagggcttggaacacagccaccgggctctgggttttccctgctagaggaaactgggcagtgacctctcgaggccatacatcctgatttggccccagtcctggtgagttactcacacgcgtgcctgaggaggcttacccaagagtgcatggccactgtgctaggccggtgacagcaaacaccagagcagcaggtgctggtgcagccctgatccatgatctgcactgaggatgcgcctgcaactggacctagagagccccagccctgggtccaccctcactgcgcctgcacgcggtgccacaggagagcctggccagggtgacctgggagcagggcccagctggcatgagcaccacagtcattcccacctgctctgtgccccttgcagggtaggggacctcacagctgtgggcatggccaaaggcccctcagctccacctgaatgttggagtatttgcaaggagaacgtgctccaatgtccctgtgtcactgacagctcatgcagatgaacaaccaactcctcaagcacgggctggaggaggctcctgtgggaaagtgggctgtggacccttagagccccagagaggagccaggctgcaggtggaggcatcgcctccagggtccccacagaggacatcgggcaaggtctgcacatggttttggttgtcccatcagagggggtgatagagtacagccccccacaacaaagaactgccccgccccaaatgtcagtagtgtgggagccaagaaaccctgctatggggcagtggtcagagacctttgtcgtgctttgaaaggggctgggctgggctgggcagggcagggcgggtcgtggcccacctggggccacagttcagagccacacttgggtctttgaggctgcccacccctcccagctgccagcatggggttggggggtgtccacccccatcagactgaggaggaaacagacactgtgtcacccagaagcatccctatgtcaccctgtgaggctggccttggacccaggactctgggcgcctggtcagcaccccagtgtgaacacatcctgccctggggcctggtcccagcagctcacacagaccagggctcgcccaaaggcaggtaggcagggccactgctgaccatgcacctggtgggccgtgattctggaactaatggtctctgcctggcagggaggccgccagggcctctgggcttcacccctccccaccttcacaggggacctcgcctcagtgggaatgttctggagccggaacccaaggttggaatcccagctcctcccctttctagggcaagctcccagcctgtctgtactcagtctccccaactgtcaaatggtaataaaacagtcctgtcctca

SEQ ID NO: 965 - DNA, 2192 bp, Homo sapiens
  ENST00000473607
gcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctggacaccaggacagagtgacagaggaggagaccggagaggagagccagtccagtcagggcccaaacatcacaccagaggctctaacagagaactgaatacaaagaagtgttccttgggtattgaagagtggaaggcagagagcccaaagttattggggacagcgactgcaggaagcagctgccactgtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggtgggagcccaacatgtacctgccagccactgccaccatcagcttctgggcagtggcacgggggggacttctgtggaggcccttttacctgccaggaggagctgggtcctggggaggctatgggaccgaggccatcagatgggccaggctggggctccttgcctgaggctcagaaaaggcttctcagaggaagggatatgagaaacaggagacatttcagcagagtgggctcaggggaggtgcctggtggaggtgaggaggtgcggaagccaagggatgcttccaaagtgggcgcaggctgggcctcccaggcagacaaagcacttccctcaccagcctgggctggaggggacttagctcctgcacgcagaagacagcaagggccagagaagggctggcctggtctctgcttgctcagccaggctctgactactggaatctataggtttcacattttct

SEQ ID NO: 966 - DNA, 715 bp, Homo sapiens
  ENST00000413612
gccgtgacctgtggtcacatggcctgagcggcagggcggctcagtcacctgggcagctggtactgctgagaggcagggtggcaggctatgggccggagcccacagctgcaggaggggcccggggatcatatgtgagggctgcttgcccctgcccgaggacaggctggcagggacggccacaggcagaggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggc

SEQ ID NO: 967 - DNA, 2913 bp, Homo sapiens
  ENST00000484724
agataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatggtaagggcacggctgtgggtcacttgcctgctcaaagccacccatgctcctgtccttggactcaggcctcacaggaagaccctaggctcctctggagaaaatggaaaaaaccagacccaggaaggaacactgaccctgatttgtccctgaccacccggctggtcctgagcacagggtgtccgaggcagtttacccacttctctgttctgggaaagctgggctccctacccttcctggctaggcacccatctccaggctgagtgccctgtgtgggtgtcaggcaacctagaatcagagagaagccctcccagggagcctgggttcagggcctctctttggtctatcagaaacacctctgggtgtggggtcattaagcctctgtgcctcagctcccatctctttgaacggcgatgccatggtaacttagcacgtgcagagccttgggagccatgccggccacctgctcttgttattagcagactacaactcacggtaccagcaaacactgatggagcaccttttataccagaacaatgtatatgcgttaaatttaatctgcctaacaacactatgagatatgtataaatattatatccttatagaggaaaaaaacagagatttaaataacttgtccaggatcatccaagctagcccgtggcagagctgggattcagactctgaaattctggctccaaagccgtgatgctggtcttggccatggtagcttcctgttcatatgcactctactactccttctcacatgagcagccgggggtagggagagggcaggcagggatcttcccacacactgacagggtccggacaaaccccatgggcgtggtacccccagccgtgttgctgtgtccggcctaccagagtgaggcgtggcagtatggggcctggcctttgctcgctcttggtgtccagtctgccatgctcccctgtcagaaggtctaggctgctgttgatgtctgcaatgtagtgttttgggtatccaagattgatatatgcagttgcaagagaatatctgtctgtggtcaggttccctagaagcagcatctaaggtaaaaattcttgtgcaagtgatttattgagggaatgttccagaaaatcatgcgaggcagtaagggcagaggaaagcaaagcaaaagtaaaggttcaggagaagtctagcctggggctgctcccagggtgggttttggagtattaactgcaccctccaattatacctgcctgtccccacctctgtcagcctttggtttcagtggcccctggggtggggtggaggacccaccaggcataatccctcggcctctttgtgtacaggagctcttatccatccacagcaagcaaggatgggacagtgcaggccgttatcatccagcccttgctgcagctggaggacagggcaccagccacaggggtctgagcagggcacccacagcatctgtccagagacctgcaaagacaggaatgcaaagaaggcaattaagtgtcttaagaggaagctggggttatcagctctctcacaagagctttgtccactgtccagaggtggtcagggtgggaggggagtgaggagagaccagctgagcacacacaccctgctccccacagatcaacccagaagaccctgggttgaagcatctctcagccacgccctgtggagtctggctgggctttagcttgcagaaagctccagaacatctttgaaaggcaatggggcgagggtcaggccgagaggcaagttccagttctggcagagcatgcatacagagtaccattcttacacagccactcttaacgcacagtgacatgcacccacccatgagcttatccataactctttttgtacatgtgttttttttcctggcccctaacaaaagcatttgttgaaaaactattgataaacaagcaggccccaaacaattcaaacatcttattaaatacagtaaatctgaggcagacactagagtagcccagagtcatgagctacaatgggggcagttcatgtctggcagccagaatccccttgaactgatggctggacgcaggctctacctgggaccagcttgaagtgctatcctgaagctgcagactgcagggccggccagaccctttttcagcctctcctcttcccacctctgtatcccacacaggcatctggtgatgttctccaggtgtttctgtggcagttctgggagctactgggtgattgcaagattagtttttttttctaagttgactttctatgtggtgcctgaatgacgttttctttttttgttcagtaggaatccttttttatagaagtaataaagtcattacacttaaaaacaaa

SEQ ID NO: 968 - DNA, 1010 bp, Homo sapiens
  ENST00000493803
acaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatggtaagggcacggctgtgggtcacttgcctgctcaaagccacccatgctcctgtccttggactcaggcctcacaggaagaccctaggctcctctggagaaaatggaaaaaaccagacccaggaaggaacactgaccctgatttgtccctgaccacccggctggtcctgagcacagggtgtccgaggcagtttacccacttctctgttctgggaaagctgggctccctacccttcctggctaggcacccatctcc

SEQ ID NO: 969 - DNA, 615 bp, Homo sapiens
  ENST00000490367
atatctgatatgtgataccatatgggagcaggctctgaaagaacactacaagtagagaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgca

SEQ ID NO: 970 - DNA, 1020 bp, Homo sapiens
  ENST00000460368
acagtaagtcttcttgacctaagcgggaaagagcgcaggcccctgcggggttggcttttacatggcatttatagacccgcccggagagggtgcgctgcgctcccgccatagtcccaccaccggtgagcgccgcccccactcggctgactctccgcccgccccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtgagtttctgggctctcgagagcgctggactcccggcggaaaggaggctgccccggctgcagctccgggggctccgggggctccaggggctccaggactcggttctcaccgcaagggctcctgcggggcccatcaacttcgccgctgggacgccgggctcggggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctctt

SEQ ID NO: 971 - DNA, 689 bp, Homo sapiens
  ENST00000488356
ctttcgctctgctgtgtccgtagcacatggcaggtacttggcccatcaagagtgagagagggtgagcgagtgagtgagtcaccggcttggcgagggtctcctctgacccacttagccttgccagcgctcagaactgccagccctgctgggtgcttgggacttttcaaagccctgggaattctccaagggtccacagtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggac

SEQ ID NO: 972 - DNA, 583 bp, Homo sapiens
  ENST00000509952
gttctgtacctcacttctgatttctgcaagtcacttcctttttttttttgtctataaatttgttctgtccacgaggcaaccctggagtctctctgaatctgctgtgattctgagggctgcccaatttgtgaatcgttcattgctcaattaaacttttttaaatttaatttggctgaagtttttcttttaacatggtgtcagaagcgggatccaaagtacagcttctagcgacccccaggagtactgagtgaacaagcaaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcat

SEQ ID NO: 973 - DNA, 583 bp, Homo sapiens
  ENST00000511283
ataaatttgttctgtccacgaggcaaccctggagtctctctgaatctgctgtgattctgagggctgcccaatttgtgaatcgttcattgctcaattaaacttttttaaatttaatttggctgaagtttttcttttaacatggtgtcagaagcgggatccaaagtacagcttctagcgacccccaggagtactgagtgaacaagcaaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctggacaccaggacagagtgacagaggaggagaccggagaggagagccagtccagtcagggcccaaacatcacaccagaggctctaacagagaactgaatacaaagaagtgttccttgggtattgaagagtggaaggcagagagcccaaagttattggggacagcgactgcaggaagcagctgccactgtctggaagctgagaaggatggagtgccggtattcaagtact

SEQ ID NO: 974 - DNA, 2797 bp, Homo sapiens
  ENST00000393431
ctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaaggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaag

SEQ ID NO: 975 - DNA, 3137 bp, Homo sapiens
  ENST00000455064
acagtaagtcttcttgacctaagcgggaaagagcgcaggcccctgcggggttggcttttacatggcatttatagacccgcccggagagggtgcgctgcgctcccgccatagtcccaccaccggtgagcgccgcccccactcggctgactctccgcccgccccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagagaccgtccac

SEQ ID NO: 976 - DNA, 7403 bp, Homo sapiens
  ENST00000549335
caacatatgaaggtatccagaaaaaggaaaatgctgagatttcttgggaccagtctgccgaagttttacataactggattcgaggtcatgataaagtccctggagcttggacagagataaatggacagatggtcactttctatggctcgacattactgaatagctctgtgcctcctggagaaccactggaaattaaaggtgccaagaagcctggtctcgttaccaaaaatggacttgttctttttggtaacgatggaaaagcactgacggtgagaaatctgcagtttgaagatggaaaaatgatccctgcctctcagtacttttcaacgggtgagacgtcagtggtagaactgacagctgaagaggtgaaagtggcagagaccatcaaggtcatctgggctggaattttaagcaatgtccccattattgaagactcaacagacttctttaaatctggagcaagctcaatggatgttgccaggctggttgaagagatcagacagaaatgtggtgggcttcagttgcagaatgaagatgtctatatggccaccaagtttgaaggctttatccaaaaggtcgtgaggaaactgagaggagaagatcaagaggtggagctggttgtagattatatttcaaaggaggtcaatgaaatcatggtaaaaatgccataccagtgtttcataaatggacagttcacagatgcagacgatggaaagacttacgacactatcaacccaacagatggatctacaatatgcaaagtatcctacgcttctttggcggatgttgataaagcagtagcagcagcaaaagatgcttttgaaaacggtgaatggggaagaatgaatgcaagagaaagaggaagattgatgtatagcatgagaatgaactaatacaagcaagatctggaacaaagattgtcggagggggatttcaagctggactctagagtggccccaaaggaacagctcagagaaccactacaaatacagaagaaaaataaatagagaagttgaacacaaaagatgagtcttaccgtatcatagtcattatacagtcctgcacttaccttcccataaaacttgtgaacaccaaacagaaatctgttgcagtgtttgtaattcattgtgtacgttgctatcttgtctcttcagttagttttggaaatatttttgtgccaactggaaatcctcaaatgttcatgggttctcagaagtgtgggttctgggaatgtggttccaatgactggtactggctcagtcattgttctacttcttacacatagatgaggcaagttatatatgcttccaataccctctgcttctcctttgtaattcttgaaacaaatgatttatgaaaatatttgtttaatgtctttcttgcctactggaccatgatctctataagggcagagatctgatccatatgtgtttacctctgaattctccgtccttaggatactgcattatatgtgacaggagctcaatcaatacttgttgaatttatttctttcactgaccacacagacttgcagacctactggaagagaaccaagaagagctggcaactattgaagcccttgattcaggggctgtctataccttggccctgaagacacacattggaatgtctgtgcaaacattcagatattttgctggctggtgcgacaaaattcagggttctactattccaatcaaccaggcccgtccaaatcgcaatctgaccttcaccaagaaagagccactcggtgtctgtgccattattattccctggaactacccgctgatgatgctggcatggaagagtgctgcgtgtttggcagcaggcaataccttagtgctcaagccagcacaggtcacgcccttgactgctttgaagtttgcagaactgtctgtgaaagcaggctttccaaagggggtcatcaacatcattccaggctcaggtggcatagcaggacaacgtctgtctgaacatcctgacatccgcaaacttggtttcactggatccactcctattggcaaacagatcatgaagagctgtgctgttagcaacttgaagaaagtttcccttgagcttggtggcaagtctccacttataatatttaatgactgtgaacttgacaaggctgtgcgaatgggcatgggagcagtatttttcaacaaaggagagaactgtattgctgctgggcggttgttcgtggaagaatccatccacgacgaatttgtgacaagagtggtagaagaaattaaaaagatgaaaattggtgatccacttgacagatccactgatcatgggccccaaaatcataaggctcatctggaaaagctgctgcaatactgtgaaactggagtgaaagaaggggccactttggtgtacgggggaagacaagtccaaaggccaggctttttcatggagccgaccgtgttcacagatgtggaagactacatgtacctcgccaaagaggaatcctttgggcctattatggtcatttctaaattccaaaatggggacatcgatggagtgttgcagcgagcaaatagtacagagtatggtttggcctcaggggtttttacaagagacataaacaaagctatgtatgtgagtgaaaaactggaagcaggaactgtttttattaacacatacaacaagacagatgtggcggccccatttggcggagttaaacaatctggctttggaaaagacttaggtgaggaagctctaaatgaatatctcaaaaccaagacggtgacactggaatattagagcaacaccatcatcaggaaagccttgacagacagccctttacaactctggacacacttaagaagattgggtgtgttgaggcaggaggtgtcagccacaaaccaaaaaatacacagatggaccatgaagagggccaggccatgttaaagcatttacacatgtgcctgagtattttctaatacaccttccagtgatttggagttgttgcattttgactatgttgtatatcatacgtatttctaaaataccaagctgtttctcccctacctagacaaatctattcatggttcccatcttgaagatgtcagtaccatgcagttataatacacaaggtgcatttattggaaactttgtataatatgtacaggtttttaacctctgaactatacatagggggttattaaaaagattttctataagtcttctaaggaacagtataacctgtaaggaatgtgaaggtagttcttttttagtatttggaaataagatacatctttgtgcctttgatattccattttttaacccactgtgatgggtgatcaacctagaaacattatcttgagtacctactaggtaccaggtactatattatgttctgaggagtatagagaatttaatgatatgatggctggcccccacatagtttaaattttagtaaatagcttttgaagcaaattttacatatgatatagtagaaggctgatcctggtcgtatcataccatcttcctatctatgtaactttgggaaactctcgcaactcctctgagcctctgcttccctatgtgtaaaacagggatagtaaatgccttcctcaggacccttaataggagaattcattgcagtaatgtaagtaaagcacctcacattaatgctttgctcatggtaagtactcaaatttaactctgatttcctccgtcaccattcttaaaagatattgagatagtttaattaactagatgaattcatttcccacaacccttttcaatcatcaattcctagatatttttctcatccattgttctgacacaatgcctgatacagcagcactgaaaaatgccacacaatgaaaaatggcaatagtacaaggaaaaggggtgcttttctttgggcagctcgctcgtccttcatgggacatcttactttccatttttctacctattggttctgctgttcactggctgtgtgatcttgggcaagatagtaatctaatatctcagagcctaggttgagtatctataaaatgaaaatcaaatctctatctcagtaggtgttgcaaggattcagtgagataatatacataatgcacttaacaaggcgtttggaccatagcattgaagaaatggaaactattaacagcccatttcccattggcagacagaagtagtcaggtgagtaaattttcaccatctatgtgtgactagaaggcggcaaatttctgaatcacatgagtctccaaaagatagccagaaagttaaattctattaatcctcctttaaaaataaaatttcagtaaacattcctttttctttggctttgaagaagccttagggaatatttgtcattttggagacttggcagaataacatgaggggattgtagggaatcaataaaaactaaacaacaaaatcagagtcagagaacattttcaaaaggaagaataggaggtttgatcccagcatgataaacagagcgaatttggcctggaagcacttttgattatactatagctcatttaccatcccagagtttggcacagctgaaattttaagttggaatgaatattcactgggcccaaaatgacagttcatatttgaataaaagtgacaaaagcctttttataagtaatcacttttaagtgaaatgttttaactgatttcatgtgatttagaatatgatttaatcaaattattttaatgatagatggaatggcagacaaaaacatgcctgtccttctagactgattttactttaccctctaatattcatctcagtagcagtgttttaaatattctctgggctgcaaaactctttgggaatctgataaaagctatgaacactccctgtgtcccgcttctacccccaaaattcatgtgcacacacacaattctgcaagtatcttcaaagggttcacagacctcccaaaggccatgcttgggccccagattaagaactcctttctccatagcaagttttaaacatttcttaccagcttacatttttagatctggctgatcagaatcaaaggctctgtgtaatacataaagttaccaagtgaactggaattggaacatcaccctccccagcctgctaggtgatttacttaacacatagagtaataaaatcatcgctgttgctttagatcacggattattttgctaataatgctaaggatgaagctgtgatcttattatcacctgaatcgggaggtgtggacactttaagcagttccactttccttctaattccccatccccatgcctttgctaaagctgtcccttttgctctaacacccttcctggaccttcctaccctagctgggctaagtgtttctcctcagcgttcccacttgtttcaaacatagcacttaccacttgtactaaaattacttgccttcttaattagatatgaacaaccctccccaactccagtatgggccttctgtcaataataatacgatatgacagctaccatttattaagggcctcctgtatgaaagaccttaggctaagcatgttttaaatgttatttaatcttcacaatctctgaaaaaaatgaagaaatcaacgtgcttttcttactacctctacccctaagccattattacttttttttttttttgagacagagttttgctcttgttgcccaggctgcagtgcagtggtgcaatcttggctcactgcaacctctgcctcttgggttcaagcgattgtcatgccttagccttccaagtagctgggattacaggtgtgtgccactacacctggctaagtagagatggggtttcgccatgttggccaggctggtcttgaactcctgacctcaagtgatccacctgcctccgcctcccaaagtgctgggattacaggcatgaaccactgcacctggcctgttacctctttcctacaattttgctcaagtctcccaactggtcttctggattcctctcttctgcggtcctgttcaaagcttaagtcagacagtgtcacttcactcgtctgtttaaaacctttcaatggcccccatttcacgtagaccaaagtccaacgtatttacctggcctactgatcttgctcctagctacctctgacctcatctcctgtcaatttccctctcattctgttccaccatcctgactgccttgacttcctcaacagaacaagcctgctcctgcctcagggcctctgtccttattcttcctcttcccaggggtgtgctggtaaaatatttaacaaatagttctccgggacgggggagaaaaccctcatttgtagcatttgcaggtatctatgtgtaaatactctcatcaaggctatttttgagccactaatttgccttcactgaatacagagtttgggaagagatgcatgccatcagaacaaatgcaagccagcaccagcacaccactgcctcttcctgcaactcttgtccatacacaacctcatggctggctggctcacttcctgcaggtctctcctcaaatatcatctgatgagagacacattccctgactatgctttctaaaataggccatatgcccccacattcataccccatctgctgtcattctttattctttttataagtgcattattttcatagcacttatcactacctgttgtatattaatcaatgatcttttcccattagaatgtaagtttcatgaacaggtacttgttttaatactgtatctccagtcctaatgtgtaacaggagcccaataaatgtttgctttcaaatggagaggttaagtaacctgctcaaatcacacagctattaagtggcagaacaggttttcaagcaatgcatctggtggttttaactaagtcgagatagtttttattcctaatgcctaaatcagggcctaggtagtgagctgtgggcacatattaagtattggttaaactaaaaataataagcaaaatggacattatctataaaagcttttgtggaaatggctagagctagggtaaggaaacaaatttggttccccatacctgccctccaagaaaataaagctgtcaaggaaaatctgggctaagagtaggatatgagggatgatggataaggcatgagacatgagaaataagggggattaaattattattactattatacaaatgatgcctgagtagatttttaaaatgattaaatacccaatgatgtaaaaaacatttataaaataggaaagtaagactgactcaaccataatttgttgagtcaacccaaaaatctatttggttattttcaaacagaaatagcctacagatgatatctgagattgttccaaactttttctatgaatatgtatactttttttacataattaacataatactgtatattaatttgttacctgctttttcaattaacaatatatcataagcatctatgccaataaacacaattctgcatatttcaa

SEQ ID NO: 977 - DNA, 7547 bp, Homo sapiens
  ENST00000258494
agcagaggccgagagcggcgagccgcgagccaggcagtccggggcatccagactgcaggccgcgcccaggccgcgcccaggctgcgccgcccgcctgcctcccgcgctgccgcgtcgccagtgctagcgctcctctccagcatgctgcggcggggcagccaggcgctccggcgcttctccactggccgggtttatttcaaaaacaagctgaagttggcactaattggccagagcctctttggacaagaagtctatagccacctccgcaaagagggccaccgagtagtaggggtgttcacagttccagacaaggatggaaaagctgaccctctggctttggctgcagagaaagatgggacccctgtgttcaagcttcctaaatggagggtcaagggcaagaccatcaaagaagtggcagaagcctacagatccgtgggtgcagagctaaatgtgctccctttctgcactcagttcattcccatggatataattgatagtccaaagcacggctctatcatttatcacccatccatcctgcccaggcacagaggagcctctgctatcaattggactctaattatgggagataagaaagctgggttttctgttttctgggctgatgatggcttggatacaggacccatccttcttcagagatcatgtgatgttgaacccaatgatacagtggatgcactttataatcggtttctttttcctgaaggaatcaaggccatggtagaagctgtccaactcatagctgatggaaaagctcctcgtataccccagccagaagaaggggcaacatatgaaggtatccagaaaaaggaaaatgctgagatttcttgggaccagtctgccgaagttttacataactggattcgaggtcatgataaagtccctggagcttggacagagataaatggacagatggtcactttctatggctcgacattactgaatagctctgtgcctcctggagaaccactggaaattaaaggtgccaagaagcctggtctcgttaccaaaaatggacttgttctttttggtaacgatggaaaagcactgacggtgagaaatctgcagtttgaagatggaaaaatgatccctgcctctcagtacttttcaacgggtgagacgtcagtggtagaactgacagctgaagaggtgaaagtggcagagaccatcaaggtcatctgggctggaattttaagcaatgtccccattattgaagactcaacagacttctttaaatctggagcaagctcaatggatgttgccaggctggttgaagagatcagacagaaatgtggtgggcttcagttgcagaatgaagatgtctatatggccaccaagtttgaaggctttatccaaaaggtcgtgaggaaactgagaggagaagatcaagaggtggagctggttgtagattatatttcaaaggaggtcaatgaaatcatggtaaaaatgccataccagtgtttcataaatggacagttcacagatgcagacgatggaaagacttacgacactatcaacccaacagatggatctacaatatgcaaagtatcctacgcttctttggcggatgttgataaagcagtagcagcagcaaaagatgcttttgaaaacggtgaatggggaagaatgaatgcaagagaaagaggaagattgatgtatagacttgcagacctactggaagagaaccaagaagagctggcaactattgaagcccttgattcaggggctgtctataccttggccctgaagacacacattggaatgtctgtgcaaacattcagatattttgctggctggtgcgacaaaattcagggttctactattccaatcaaccaggcccgtccaaatcgcaatctgaccttcaccaagaaagagccactcggtgtctgtgccattattattccctggaactacccgctgatgatgctggcatggaagagtgctgcgtgtttggcagcaggcaataccttagtgctcaagccagcacaggtcacgcccttgactgctttgaagtttgcagaactgtctgtgaaagcaggctttccaaagggggtcatcaacatcattccaggctcaggtggcatagcaggacaacgtctgtctgaacatcctgacatccgcaaacttggtttcactggatccactcctattggcaaacagatcatgaagagctgtgctgttagcaacttgaagaaagtttcccttgagcttggtggcaagtctccacttataatatttaatgactgtgaacttgacaaggctgtgcgaatgggcatgggagcagtatttttcaacaaaggagagaactgtattgctgctgggcggttgttcgtggaagaatccatccacgacgaatttgtgacaagagtggtagaagaaattaaaaagatgaaaattggtgatccacttgacagatccactgatcatgggccccaaaatcataaggctcatctggaaaagctgctgcaatactgtgaaactggagtgaaagaaggggccactttggtgtacgggggaagacaagtccaaaggccaggctttttcatggagccgaccgtgttcacagatgtggaagactacatgtacctcgccaaagaggaatcctttgggcctattatggtcatttctaaattccaaaatggggacatcgatggagtgttgcagcgagcaaatagtacagagtatggtttggcctcaggggtttttacaagagacataaacaaagctatgtatgtgagtgaaaaactggaagcaggaactgtttttattaacacatacaacaagacagatgtggcggccccatttggcggagttaaacaatctggctttggaaaagacttaggtgaggaagctctaaatgaatatctcaaaaccaagacggtgacactggaatattagagcaacaccatcatcaggaaagccttgacagacagccctttacaactctggacacacttaagaagattgggtgtgttgaggcaggaggtgtcagccacaaaccaaaaaatacacagatggaccatgaagagggccaggccatgttaaagcatttacacatgtgcctgagtattttctaatacaccttccagtgatttggagttgttgcattttgactatgttgtatatcatacgtatttctaaaataccaagctgtttctcccctacctagacaaatctattcatggttcccatcttgaagatgtcagtaccatgcagttataatacacaaggtgcatttattggaaactttgtataatatgtacaggtttttaacctctgaactatacatagggggttattaaaaagattttctataagtcttctaaggaacagtataacctgtaaggaatgtgaaggtagttcttttttagtatttggaaataagatacatctttgtgcctttgatattccattttttaacccactgtgatgggtgatcaacctagaaacattatcttgagtacctactaggtaccaggtactatattatgttctgaggagtatagagaatttaatgatatgatggctggcccccacatagtttaaattttagtaaatagcttttgaagcaaattttacatatgatatagtagaaggctgatcctggtcgtatcataccatcttcctatctatgtaactttgggaaactctcgcaactcctctgagcctctgcttccctatgtgtaaaacagggatagtaaatgccttcctcaggacccttaataggagaattcattgcagtaatgtaagtaaagcacctcacattaatgctttgctcatggtaagtactcaaatttaactctgatttcctccgtcaccattcttaaaagatattgagatagtttaattaactagatgaattcatttcccacaacccttttcaatcatcaattcctagatatttttctcatccattgttctgacacaatgcctgatacagcagcactgaaaaatgccacacaatgaaaaatggcaatagtacaaggaaaaggggtgcttttctttgggcagctcgctcgtccttcatgggacatcttactttccatttttctacctattggttctgctgttcactggctgtgtgatcttgggcaagatagtaatctaatatctcagagcctaggttgagtatctataaaatgaaaatcaaatctctatctcagtaggtgttgcaaggattcagtgagataatatacataatgcacttaacaaggcgtttggaccatagcattgaagaaatggaaactattaacagcccatttcccattggcagacagaagtagtcaggtgagtaaattttcaccatctatgtgtgactagaaggcggcaaatttctgaatcacatgagtctccaaaagatagccagaaagttaaattctattaatcctcctttaaaaataaaatttcagtaaacattcctttttctttggctttgaagaagccttagggaatatttgtcattttggagacttggcagaataacatgaggggattgtagggaatcaataaaaactaaacaacaaaatcagagtcagagaacattttcaaaaggaagaataggaggtttgatcccagcatgataaacagagcgaatttggcctggaagcacttttgattatactatagctcatttaccatcccagagtttggcacagctgaaattttaagttggaatgaatattcactgggcccaaaatgacagttcatatttgaataaaagtgacaaaagcctttttataagtaatcacttttaagtgaaatgttttaactgatttcatgtgatttagaatatgatttaatcaaattattttaatgatagatggaatggcagacaaaaacatgcctgtccttctagactgattttactttaccctctaatattcatctcagtagcagtgttttaaatattctctgggctgcaaaactctttgggaatctgataaaagctatgaacactccctgtgtcccgcttctacccccaaaattcatgtgcacacacacaattctgcaagtatcttcaaagggttcacagacctcccaaaggccatgcttgggccccagattaagaactcctttctccatagcaagttttaaacatttcttaccagcttacatttttagatctggctgatcagaatcaaaggctctgtgtaatacataaagttaccaagtgaactggaattggaacatcaccctccccagcctgctaggtgatttacttaacacatagagtaataaaatcatcgctgttgctttagatcacggattattttgctaataatgctaaggatgaagctgtgatcttattatcacctgaatcgggaggtgtggacactttaagcagttccactttccttctaattccccatccccatgcctttgctaaagctgtcccttttgctctaacacccttcctggaccttcctaccctagctgggctaagtgtttctcctcagcgttcccacttgtttcaaacatagcacttaccacttgtactaaaattacttgccttcttaattagatatgaacaaccctccccaactccagtatgggccttctgtcaataataatacgatatgacagctaccatttattaagggcctcctgtatgaaagaccttaggctaagcatgttttaaatgttatttaatcttcacaatctctgaaaaaaatgaagaaatcaacgtgcttttcttactacctctacccctaagccattattacttttttttttttttgagacagagttttgctcttgttgcccaggctgcagtgcagtggtgcaatcttggctcactgcaacctctgcctcttgggttcaagcgattgtcatgccttagccttccaagtagctgggattacaggtgtgtgccactacacctggctaagtagagatggggtttcgccatgttggccaggctggtcttgaactcctgacctcaagtgatccacctgcctccgcctcccaaagtgctgggattacaggcatgaaccactgcacctggcctgttacctctttcctacaattttgctcaagtctcccaactggtcttctggattcctctcttctgcggtcctgttcaaagcttaagtcagacagtgtcacttcactcgtctgtttaaaacctttcaatggcccccatttcacgtagaccaaagtccaacgtatttacctggcctactgatcttgctcctagctacctctgacctcatctcctgtcaatttccctctcattctgttccaccatcctgactgccttgacttcctcaacagaacaagcctgctcctgcctcagggcctctgtccttattcttcctcttcccaggggtgtgctggtaaaatatttaacaaatagttctccgggacgggggagaaaaccctcatttgtagcatttgcaggtatctatgtgtaaatactctcatcaaggctatttttgagccactaatttgccttcactgaatacagagtttgggaagagatgcatgccatcagaacaaatgcaagccagcaccagcacaccactgcctcttcctgcaactcttgtccatacacaacctcatggctggctggctcacttcctgcaggtctctcctcaaatatcatctgatgagagacacattccctgactatgctttctaaaataggccatatgcccccacattcataccccatctgctgtcattctttattctttttataagtgcattattttcatagcacttatcactacctgttgtatattaatcaatgatcttttcccattagaatgtaagtttcatgaacaggtacttgttttaatactgtatctccagtcctaatgtgtaacaggagcccaataaatgtttgctttcaaatggagaggttaagtaacctgctcaaatcacacagctattaagtggcagaacaggttttcaagcaatgcatctggtggttttaactaagtcgagatagtttttattcctaatgcctaaatcagggcctaggtagtgagctgtgggcacatattaagtattggttaaactaaaaataataagcaaaatggacattatctataaaagcttttgtggaaatggctagagctagggtaaggaaacaaatttggttccccatacctgccctccaagaaaataaagctgtcaaggaaaatctgggctaagagtaggatatgagggatgatggataaggcatgagacatgagaaataagggggattaaattattattactattatacaaatgatgcctgagtagatttttaaaatgattaaatacccaatgatgtaaaaaacatttataaaataggaaagtaagactgactcaaccataatttgttgagtcaacccaaaaatctatttggttattttcaaacagaaatagcctacagatgatatctgagattgttccaaactttttctatgaatatgtatactttttttacataattaacataatactgtatattaatttgttacctgctttttcaattaacaatatatcataagcatctatgccaataaacacaattctgcata

SEQ ID NO: 978 - DNA, 2746 bp, Homo sapiens
  ENST00000552270
agtgctagcgctcctctccagcatgctgcggcggggcagccaggcgctccggcgcttctccactggccgggtttatttcaaaaacaagctgaagttggcactaattggccagagcctctttggacaagaagtctatagccacctccgcaaagagggccaccgagtagtaggggtgttcacagttccagacaaggatggaaaagctgaccctctggctttggctgcagagaaagatgggacccctgtgttcaagcttcctaaatggagggtcaagggcaagaccatcaaagaagtggcagaagcctacagatccgtgggtgcagagctaaatgtgctccctttctgcactcagttcattcccatggatataattgatagtccaaagcacggctctatcatttatcacccatccatcctgcccaggcacagaggagcctctgctatcaattggactctaattatgggagataagaaagctgggttttctgttttctgggctgatgatggcttggatacaggacccatccttcttcagagatcatgtgatgttgaacccaatgatacagtggatgcactttataatcggtttctttttcctgaaggaatcaaggccatgaagctgtccaactcatagctgatggaaaagctcctcgtataccccagccagaagaaggggcaacatatgaaggtatccagaaaaaggaaaatgctgagatttcttgggaccagtctgccgaagttttacataactggattcgaggtcatgataaagtccctggagcttggacagagataaatggacagatggtcactttctatggctcgacattactgaatagctctgtgcctcctggagaaccactggaaattaaaggtgccaagaagcctggtctcgttaccaaaaatggacttgttctttttggtaacgatggaaaagcactgacggtgagaaatctgcagtttgaagatggaaaaatgatccctgcctctcagtacttttcaacgggtgagacgtcagtggtagaactgacagctgaagaggtgaaagtggcagagaccatcaaggtcatctgggctggaattttaagcaatgtccccattattgaagactcaacagacttctttaaatctggagcaagctcaatggatgttgccaggctggttgaagagatcagacagaaatgtggtgggcttcagttgcagaatgaagatgtctatatggccaccaagtttgaaggctttatccaaaaggtcgtgaggaaactgagaggagaagatcaagaggtggagctggttgtagattatatttcaaaggaggtcaatgaaatcatggtaaaaatgccataccagtgtttcataaatggacagttcacagatgcagacgatggaaagacttacgacactatcaacccaacagatggatctacaatatgcaaagtatcctacgcttctttggcggatgttgataaagcagtagcagcagcaaaagatgcttttgaaaacggtgaatggggaagaatgaatgcaagagaaagaggaagattgatgtatagacttgcagacctactggaagagaaccaagaagagctggcaactattgaagcccttgattcaggggctgtctataccttggccctgaagacacacattggaatgtctgtgcaaacattcagatattttgctggctggtgcgacaaaattcagggttctactattccaatcaaccaggcccgtccaaatcgcaatctgaccttcaccaagaaagagccactcggtgtctgtgccattattattccctggaactacccgctgatgatgctggcatggaagagtgctgcgtgtttggcagcaggcaataccttagtgctcaagccagcacaggtcacgcccttgactgctttgaagtttgcagaactgtctgtgaaagcaggctttccaaagggggtcatcaacatcattccaggctcaggtggcatagcaggacaacgtctgtctgaacatcctgacatccgcaaacttggtttcactggatccactcctattggcaaacagatcatgaagagctgtgctgttagcaacttgaagaaagtttcccttgagcttggtggcaagtctccacttataatatttaatgactgtgaacttgacaaggctgtgcgaatgggcatgggagcagtatttttcaacaaaggagagaactgtattgctgctgggcggttgttcgtggaagaatccatccacgacgaatttgtgacaagagtgatccactgatcatgggccccaaaatcataaggctcatctggaaaagctgctgcaatactgtgaaactggagtgaaagaaggggccactttggtgtacgggggaagacaagtccaaaggccaggctttttcatggagccgaccgtgttcacagatgtggaagactacatgtacctcgccaaagaggaatcctttgggcctattatggtcatttctaaattccaaaatggggacatcgatggagtgttgcagcgagcaaatagtacagagtatggtttggcctcaggggtttttacaagagacataaacaaagctatgtatgtgagtgaaaaactggaagcaggaactgtttttattaacacatacaacaagacagatgtggcggccccatttggcggagttaaacaatctggctttggaaaagacttaggtgaggaagctctaaatgaatatctcaaaaccaagacggtgacactggaatattag

SEQ ID NO: 979 - DNA, 527 bp, Homo sapiens
  ENST00000548418
ggtagaagaaattaaaaagatgaaaattggtgatccacttgacagatccactgatcatgggccccaaaatcataaggctcatctggaaaagctgctgcaatactgtgaaactggagtgaaagaaggggccactttggtgtacgggggaagacaagtccaaaggccaggctttttcatggagccgaccgtgttcacagatgtggaagactacatgtacctcgccaaagaggaatcctttgggcctattatggtcatttctaaattccaaaatgggtaggttcttcagacacaatgtaacttaggttttgactagataagtcatttttcccctttgccactgtgctatatacacagcataagattaatgaacatgtaattttctaccataagaataattaacttaaataattagaagttacgcttttgctaaccatcgtagatcatagtatatttttgcttttcagcttcaattaatggccaacataatgggcttttagctgaataaattttagtttttctgcacttga

SEQ ID NO: 980 - DNA, 486 bp, Homo sapiens
  ENST00000552427
tctccagcatgctgcggcggggcagccaggcgctccggcgcttctccactggccgggtttatttcaaaaacaagctgaagttggcactaattggccagagcctctttggacaagaagtctatagccacctccgcaaagagggccaccgagtagtaggggtgttcacagttccagacaaggatggaaaagctgaccctctggctttggctgcagagaaagatgggacccctgtgttcaagcttcctaaatggagggtcaagggcaagaccatcaaagaagtggcagaagcctacagatccgtgggtgcagagctaaatgtgctccctttctgcactcagttcattcccatggatataattgatagtccaaagcacggctctatcatttatcacccatccatcctgcccaggcacagaggagcctctgctatcaattggtgagattttttctttttactttttttttttgagatggggtcttgctatg

SEQ ID NO: 981 - DNA, 5499 bp, Homo sapiens
  ENST00000553458
ccaatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccccgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtaattccatcattttgggaggccacagtgggcagattgcttgagcccaggagttgaagaacgtggcgaaaccccgtatctattatttaaaaaaattgaaaaagtaaaaaaagaaaagggaaaaaaaattttttaaagaagatgttccaataattgcaagaagaactcttagatggggaaacaggacagaaataactcaccgcttttggttgatcctcaaacatagcgctacctaaatgccactgggagagacctcctgcaaagttttctttagcccctcttttatcccacaatacacaagatataatccatttttatatatcccaaagttgtggcaacagcttctttcttttctgctcaatgccactttgtttcctagtaattcatgaccactattaattctatcattgtcactgctcctgcttaagatcacttctcaaggatacctcagtaagcaatggataaatcaactttttgttatatgtgccaagtactaagtttcagggttctcttcagcaatcattaattaatacttcagccattaattcagatgcaaataattttcttttttcttttttttgagatggagtttcactcttgttgcccaggctggagtgcaatggcgtgatctcagctcaccgcaacctccgcctcccaggttcaagcgattctcctgcctcagcccccctagtagctgggattacaggcatgcgccaccacacccagctaattttgtatttttagtagagacggggtttctccgtgttggtcaggctggtctcgaactcctgacctcaggtgatccgcctgcctcggcctcccaaagtgctgggattacaggcatgagccaccacacccagccagatgcaaataattttcttagaaaattatttcaaaagttattttaggcccagaaatcaaggattgttccaaccatgaaaatgggtaagacacctgccttaagcaaatctaacctgctattacttgccaaattttatatattcttttctcttgcctgtatttctaattagtgatttgtttaatgaagaactcttcatgtagagcaattaactgggcctaagaaatttcgaagctttccatgacataaagtggttaaaaaaaaatgctttgacagtcttcttctgccattagttcaactgcctttacgcttttttttttttttttttttttgagatggagtttcactcttgttgcccaggctagagtgcaatggcgtgatcttggctcactgcaacctctgcctcccgggttcaagcaattctcctgcctcagcctcctgagtagctgggatttcaggcatacgccaccatgcctggctaattttgtatttttagtagagacagggtttctccatgttggtcaggctggtctcgaactcccgacctcaggtgatctgcctgccttggcctcccaaagtgctgggattacaggtgtgagccaccacccccagccgcctctatgctttttgtttctttgatatatctaaacttaaggtcagaacagaaattcatgtgctgaacagaatggattctttttgcagtaccaatccaattgaatcctctttttattttcctgcgtccttaccagtcactttgatagtgctaactaacctacactatgggggttattcatgaattaagtatgataaaaaaaaaaaagaccttgaaaatgttgtgtaccctgtggatttgaggcttattactaccacctggctggataaaatgtcaaaaccttcaatcacttaaggtgactggaacttttgtaaaatacacttatgatcctactgggccttttttttttttttttctgctttcctaaatatgaggcaatagaaatttataatttgagactacagtaccccttgttttagctcttatcacagctggcaactggtagtgattttttttgttgttgttttgttttgttttgagatggagtctcgctctgttgcccagggtggagtgcagtggcacgatctcggctcactgcaacctccacctcctgggttcaagtaattctcctgcctcagtctcccgagtagctgggattacaggtgcatgcccccacacccggataattttttgtacttttagtagagacagggtttcaccatgttagccaggatggtctcaatctcctgacctaatgatccgcccacctcggcctcccaaagtgctgggattacaggcgtgaaccaccgcacctggccctggtagtgatatttaatccaatccaacaactataggctgggttaaataaaaggtcattattgtctatattccaagtggaattaaatgtagtcacagagattcctaacattttccttatatttaagggaaatcacttctaaaaaaacacactaatcagaactgtgatgctctaattagaaacaactcatctggccaactatttgctgctcagagtttcttatttcttagatgaaaaaaactcatcagttatattcatgtgatcgcggctaaaaagtcagtattttctttttgttctaatgtggcttcatttgaaatttctcagattctacattgtactaattatgaataacaaattataaattaaaaactcttaaagagaaaaacttggcttaaaaaaatcatttcatatctccttataagcctttgtcctctaggttgtaatgactctgacttcccacctgtgatggaaagctaagagtcacaaggtcactatgtttactcttacgtaaaagatagtacacattttggctaggctgtttacttcaaaaggcaacctataggtttctacacaaaaagaggcacacatttgcatttgcattagtataatatgcatttgtacggatattgctttaaaaatttatgtaatctactaatgctatttattactcattccactgatccctgaagtctctcaactagtagagaaaataaccgtgatttagcaagaagcgacatggggaagggtgacaacaatatacattgtttgattagatacagactccttactgtgtcagactcctgaggttcttttggaatagtgggtagcaccacttcaccagaagagtctgatattgcaatttgctgggtgatgaagattttatcttgaagcttactttcatccctgcaataatgacaaaataacagaaccgtcaacaactctacacacatgaaacctggtttagaataacagacttgtcatattactttcaattagcacattcaagatgcccacaagaaccatcgtgttgggctcatgtttattacttaagcaagagagctcttacccaaattcctttgtttccccactgtcagaaacaacatagtctggaactggaggcctagaactctggttgtatttcctgtagtgggtaaaagtcaacaaagataatgaatgaggcagtgtctcctcatgcct

SEQ ID NO: 982 - DNA, 2221 bp, Homo sapiens
  ENST00000554501
gtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcagaatctcattttgcacaaacccttaacttggaagggcaagtcagtgtaccctgcaccccttcattggcctgaaccacttcctgtcctcagggctgaagagaacaggacaaagctaactagtacacagtgtggagagctgatggcctgacttctgtgttccagaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccccgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtaattccatcattttgggaggccacagt

SEQ ID NO: 983 - DNA, 1869 bp, Homo sapiens
  ENST00000350259
agtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcagaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccccgcaaagtttctatagggaactgcctagtgtaacaatgaaaccagatttctcacttgctcttcatacttctattttgaggtaactgttgtaactatgaaatgctta

SEQ ID NO: 984 - DNA, 1382 bp, Homo sapiens
  ENST00000555126
ggtggtgggtgcctataatcccagctgcttgggaggctgaggcagagaattgcttgaacctgggaggcggaggttgcagtgagccgaaattgtgccactgcactccagcctgggcaacagagcgagactccgtctcaaaaaaaaaaaaaaaaaaaaagaaaaagtaaaagaaaaacacaggaaaacttcaaatccatagcagtggggaaaggggaaatttgccatgttgagaatccatttgctcctttgtgagtgatcatttattttcttcttaaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccccgcaaagtttctatagggaactgcctagtgtaacaatgaaaccagatttctcacttgctcttcatacttctattttgaggtaactg

SEQ ID NO: 985 - DNA, 1323 bp, Homo sapiens
  ENST00000554231
caatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaaggtaactgcccttatgcatatggctacttaatctggctaccaaaaaatcaaggtgttgagtgatggttggatgttttaggataaggaacctacttgtaaggaggaaaggatttactcattttaacctccatgtttgttgatgattttgccatctttgtgcgccaaggtaactgattggggaatagcagtgcttgttgccctacagtatatattgggacactagaaatatggattagggctagacacagataagattaaaaagaaacttttttcttcagtgtgaagagaatacatgagggtatttaattcagagaatttgcagatctcagagatactgaaggccttctaattcatgtaataatagctaatacttaaatagtgcttctgtgtttcaggcaccgttcctagtgctttttatctattaatctttataatcaccctttgaggtaggtattatttttccattttgcagaagagaaaaatgagacatagtgaa

SEQ ID NO: 986 - DNA, 580 bp, Homo sapiens
  ENST00000553814
gtgcggagctagggcggccgagagccatggcggcgctattggcggcggcggcagtgcgagcccggatcctgcaggtttcttccaaggtgaaatccagtcccacctggtattcagcatcttccttctcttcttcagtggccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcggctgaagagaacaggacaaagctaactagtacacagtgtggagagctgatggcctgacttctgtgttccagaggtggttgagcatgcctgtagtgtgacatccctcatgatgggagagaccatgccatccatcaccaaagacatggacctttattcctaccgtctgcctctgggagtgtgtgcaggcattgctccattcaa

SEQ ID NO: 987 - DNA, 726 bp, Homo sapiens
  ENST00000556852
agtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttggtatgaaatctaaatggtatgcttttccaaactgtcacctagggcatgtttgtcactctcacagagaccttttcagccaccctcccttactctgcagtatgcagagacgttgatcatgactctctcccttgtactgcatctcctccagtcttattcttcctttgctacctcagaatttaaaagaggaacattcttgcattaatttctatttgtgtgtcttctctctagaaagaaattgccaagttaatcacattggaacaagggaagaccctagctgatgctgaaggagatgtatttcgaggccttcgtaagctgggagcccctt

SEQ ID NO: 988 - DNA, 1519 bp, Homo sapiens
  ENST00000395319
gggagccagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattcta

SEQ ID NO: 989 - DNA, 1722 bp, Homo sapiens
  ENST00000395321
atgcaggccacgcccccggaggagtcacgtagctctgcgacatccgcagcctcatttaccagagggagccagggctgcagcctcatctgtttgcggatcagaacccgagctgtgcttgtggctgcggctgctaactggctgcgcacagaagctgagagaagagggtggcaataagtacttttgcctcattctgaagccttggaaggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattcta

SEQ ID NO: 990 - DNA, 1982 bp, Homo sapiens
  ENST00000226253
attacttcctgccctgaacttgggcaccttgaagatgcttctgccccacctactcaacctgttgttactgttctggtgcctcctcttcaccagactaagcttaatccccagcatccagcaagtgcccggcacgtggtaaagggattgtggcagaaatgaacgcaaggtcatggccaggctccccgaggtgggagggcagtccctaacagccacggatgcctggcggggcgctcactccacctcgccgccccgcctctgagggcgtggtcttgccccggacaccagtcctggggagggggtgtggtcagggcggggcatgcaggccacgcccccggaggagtcacgtagctctgcgacatccgcagcctcatttaccagagggagccagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattcta

SEQ ID NO: 991 - DNA, 922 bp, Homo sapiens
  ENST00000460201
ggaaaggccaggacttttgcctacctcaacaagggaccaagttcagtgaaagaagggttggcatccttgattgggcagcagatttatcagaagagctgtggcttcagggctgctcacctccccacccccaccctgcatctttccccagggctgggaaggatgcctaccagggacaaaaggagatgtgggaactggagccctaagcttgctagctgtcagaaggactggtgccacttgatgcccaggactcatgccaaggactgctgccctgttcccagccccttgcttgatggggaggccatttggcccatctggccaggagaggcagcagagggtgaggtctggcttttttatcttgtctccactccagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcag

SEQ ID NO: 992 - DNA, 686 bp, Homo sapiens
  ENST00000584086
atttaccagagggagccagggctgcagcctcatctgtttgcggatcagaacccgagctgtgcttgtggctgcggctgctaactggctgcgcacagctgagagaagagggtggcaataagtacttttgcctcattctgaagccttggaaggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgcca

SEQ ID NO: 993 - DNA, 580 bp, Homo sapiens
  ENST00000581807
tttaccagagggagccagggctgcagcctcatctgtttgcggatcagaacccgagctgtgcttgtggctgcggctgctaactggctgcgcacagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttat

SEQ ID NO: 994 - DNA, 579 bp, Homo sapiens
  ENST00000435638
agtctcatctctctctcaggctctctactcctttcagccttggtcctctgccctcccgtctgggtgtctgagttgtggggaattgaagtgcttcctattgctatcctcctgccaaacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgct

SEQ ID NO: 995 - DNA, 839 bp, Homo sapiens
  ENST00000578590
agcctgcatcaccactagctcccctcagtctcatctctctctcaggctctctactcctttcagccttggtcctctgccctcccgtctgggtgtctgagttgtggggaattgaagtgcttcctattgctatcctcctgccaaacaggtgaagtgcttcctgggcacagagatgacccggaggtgtcactagccctagtctccacacactaacacagctgacccgctgggccctctttcctacatcactgcagccccactggggccaacctctggtactgggtgggaataggcaataggcataggcaggcaggtttggagtacagaaaaggagaagctgcaggagcctgtgactggtatttgtgccactcctactccctacctgttcttccaaccttttcctctagaagctgagagaagagggtggcaataagtacttttgcctcattctgaagccttggaaggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaa

SEQ ID NO: 996 - DNA, 571 bp, Homo sapiens
  ENST00000582381
accagagggagccagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggtgcagcccctggccctgctctgaatggaagctgggtgtgaaaataagcttgtgtaggaggggtagcaaggagaatcctgcctggattcaaccctctgcttgtacttcctctacaggttgacaagggtgtggtgcctctagctg

SEQ ID NO: 997 - DNA, 2513 bp, Homo sapiens
  ENST00000642122
cagccttccctggctccctccccatttcctctcatgggcatttcttctaataaaatctgcagaccatattgggtctaatcccatctccagtctgcttcttggaggaaccagactaacatgactctgccctatataatacaaataattattttccatatatctgatttttagctttgcatttactttaaatcatgcttcaattaaagacacaccttctttaatcattttattagtatttctaagtatgatggaaaggttcagagctcaggggaggatatggagatccagggaggcttcctgtaggaagtggcctgtgtagtgcttcaagggccaggctgccaggccatgttgcagctgaccacccacctgcagtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttctttcaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaa

SEQ ID NO: 998 - DNA, 6220 bp, Homo sapiens
  ENST00000389048
gggggcggcagcggtggtagcagctggtacctcccgccgcctctgttcggagggtcgcggggcaccgaggtgctttccggccgccctctggtcggccacccaaagccgcgggcgctgatgatgggtgaggagggggcggcaagatttcgggcgcccctgccctgaacgccctcagctgctgccgccggggccgctccagtgcctgcgaactctgaggagccgaggcgccggtgagagcaaggacgctgcaaacttgcgcagcgcgggggctgggattcacgcccagaagttcagcaggcagacagtccgaagccttcccgcagcggagagatagcttgagggtgcgcaagacggcagcctccgccctcggttcccgcccagaccgggcagaagagcttggaggagccaaaaggaacgcaaaaggcggccaggacagcgtgcagcagctgggagccgccgttctcagccttaaaagttgcagagattggaggctgccccgagaggggacagaccccagctccgactgcggggggcaggagaggacggtacccaactgccacctcccttcaaccatagtagttcctctgtaccgagcgcagcgagctacagacgggggcgcggcactcggcgcggagagcgggaggctcaaggtcccagccagtgagcccagtgtgcttgagtgtctctggactcgcccctgagcttccaggtctgtttcatttagactcctgctcgcctccgtgcagttgggggaaagcaagagacttgcgcgcacgcacagtcctctggagatcaggtggaaggagccgctgggtaccaaggactgttcagagcctcttcccatctcggggagagcgaagggtgaggctgggcccggagagcagtgtaaacggcctcctccggcgggatgggagccatcgggctcctgtggctcctgccgctgctgctttccacggcagctgtgggctccgggatggggaccggccagcgcgcgggctccccagctgcggggccgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccttctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcaatggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggtggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttctttcaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaa

SEQ ID NO: 999 - DNA, 2520 bp, Homo sapiens
  ENST00000431873
caatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattggtaaccctaatctgatcacggtcggtccattgcatagaggagggaactgagcacatagcggtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttctttcaaattgtgtgtgctctgcttcaatgtagtcagaattagctgcttctatgtttcatagttggggtcatagatgtttccttgccttgttgatgtggacatgagccatttgaggggagagggaacggaaataaag

SEQ ID NO: 1000 - DNA, 1757 bp, Homo sapiens
  ENST00000638605
gttactacgtgctcggcaatttacacatttcaattcattcgatcctcagtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactca

SEQ ID NO: 1001 - DNA, 577 bp, Homo sapiens
  ENST00000453137
tcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagtctctcttggaagcagttgttttgcttcaccttctgcctgaggccttcctgggagaaatcgaccatgaattctagcacccagtccacgcaccagtatctgagaaagacactctcctgccccctgagacacttcctcacccaagtgcctgagcaacatcctcacagctccagccactctcctgcaaatggaactcctgtggagcctgctgtggttcttcccacctgctcaccagcaagattctgggtttaggctcagcccgggacccctgctgcccatgtttacagaatgcctttatacattgtagctgctgaaaatgtaactttgtatcctgttcctcccagtttaagatttgcccagactcagctca

SEQ ID NO: 1002 - DNA, 560 bp, Homo sapiens
  ENST00000498037
accctgaaagtttgcagatgcttcttcccaccaccacgtgtggatgggagcccctgttctcccagattttcaggcagagccatgcttagaaaatataagaaaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacagctatgctgagcattgatcacgcttcttctccacaaagcctcataactcaaggctgaaatcaattccaggttctattctaagagccccagatctcatacacaaagattctgattcacagatgacatattgggaccaggaatctgtattttttaaagttccccagttgactttcatgcgtaaccacattt

SEQ ID NO: 1003 - DNA, 4646 bp, Homo sapiens
  ENST00000618119
caggtcatagctccttggaatcaccaacaaacatgccttctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcaatggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggtggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttctttcaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgac

SEQ ID NO: 1004 - DNA, 2504 bp, Homo sapiens
  ENST00000610656
cctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcattt

SEQ ID NO: 1005 - DNA, 604 bp, Homo sapiens
  ENST00000622032
cggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccaggtaggcagggccgggcccgctgggcagggctcccttctcaaggccgctgcctcctcccccgccccggttctgcacgcgtactgcaccctcggacagcctcggggcctggcacgggacttgcaggatggattctgcccgctcagccaagggcgctggccgcggggaaagaggatggacggactgcagggcccgctggagttggggggcacggggaggacggggcccagggggcagctgggcagcagggcttcgggggtgcccacgcttgctggcggtcgtctccgcagtacgactggtgctcctggatccccaatgcgcccccaaccatgcgagccccgccaccgactgccaagggcgtggtgaccattgagcagatcgtggacacg

SEQ ID NO: 1006 - DNA, 356 bp, Homo sapiens
  ENST00000622781
ggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagtcaagcaggtttcagacaccacaaatgccgaatgagctgctgccattccttcatcttaccccgaactgccacaacctgtgaacaccttccatgtgaatcaatcagccttggagtcagaggagagaa

SEQ ID NO: 1007 - DNA, 446 bp, Homo sapiens
  ENST00000616521
ctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggtgggtgccctcctaccctacttgttgcctggaagagcccagcctggccgccttcactccctatctgagatctagacaccctttcaggaggcctggaagggtgaaggctggagtctgctcagagcactggctccagcatcctcctgatgtctcca

SEQ ID NO: 1008 - DNA, 636 bp, Homo sapiens
  ENST00000612275
caggccctcaacagagttgcatgggtcctggaaactgagggtcactgagagcaatgactgagggtcgtgtgctcagcactagagcagacttcacagcccaggcccgctggtgctggggtcccccacacacctgcccacgcctgctgccctcctgtggctgggagcgcacccttccctcttgtactctgcagccccacggttcagtcccttgcattggattgggcgggaggctcctccctagcacctctccacccggctgcccttgtcattctctgcgttaaacatccctcccccatctcacaggacaagggcttgcacctctgcctgcctggcctcctcgcctcccctggcacatttcctcagggatgggtctggacagctgtgggaggagccacccgctcagggcactctacctcccactccaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacg

SEQ ID NO: 1009 - DNA, 514 bp, Homo sapiens
  ENST00000617751
tgggggaggagccgggacccctgcctgactacctggggcgggcctggcccctccaccgctagcgctgaatggggacggggtgggggagtcccagcgtccgtgagggggttgccgccgggcaccgctccgcagacctggctgggtcgcccaccccggctgcgccccctgagccaggttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgc

SEQ ID NO: 1010 - DNA, 2390 bp, Homo sapiens
  ENST00000622021
ccggggccagggaccagtggtgggaggaggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaatg

SEQ ID NO: 1011 - DNA, 1945 bp, Homo sapiens
  ENST00000622238
atgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgagatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctga

SEQ ID NO: 1012 - DNA, 2506 bp, Homo sapiens
  ENST00000374391
cctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaa

SEQ ID NO: 1013 - DNA, 363 bp, Homo sapiens
  ENST00000483623
tcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagtcaagcaggtttcagacaccacaaatgccgaatgagctgctgccattccttcatcttaccccgaactgccacaacctgtgaacaccttccatgtgaatcaatcagccttggagtcagaggagagaa

SEQ ID NO: 1014 - DNA, 446 bp, Homo sapiens; identical to SEQ ID NO: 1007
  ENST00000475300

SEQ ID NO: 1015 - DNA, 636 bp, Homo sapiens; identical to SEQ ID NO: 1008
  ENST00000493336

SEQ ID NO: 1016 - DNA, 514 bp, Homo sapiens; identical to SEQ ID NO: 1009
  ENST00000481117

SEQ ID NO: 1017 - DNA, 604 bp, Homo sapiens; identical to SEQ ID NO: 1005
  ENST00000498461

SEQ ID NO: 1018 - DNA, 2390 bp, Homo sapiens; identical to SEQ ID NO: 1010
  ENST00000542434

SEQ ID NO: 1019 - DNA, 1945 bp, Homo sapiens; identical to SEQ ID NO: 1011
  ENST00000612635

SEQ ID NO: 1020 - DNA, 6644 bp, Homo sapiens
  ENST00000264276
aagcgcatctcaggactgatagctccgccctaaactaagggagagactgtgctcccaagtacgtagcctgcagtgcctaacgcattctcagcaattttgacccccaacagacgccgtcgacagtctcccaagaacaattcccaggagctcggattccaagagccgcccgcgccctcgtttaccttcgctagtcgccctgcagccccgccctgtccggaggccccgccctccatgaatcagctgatcccgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcagcctcttttagaagaagcaattcctaatctccacagcccgcctaccacaagcacctcagccctaaacagcctggtggtctcttgtgcatctgctgttggtgtgagagtggctgctacttatgaagctggtgccttgtcactgaagaaagttatgaacttttatagtacaaccccttgtgaaactggagctcaggcaggcagtagtgccattggccccgaaggtttgaaagatagcagggaagaacaggttaaacaggaatcaatgcaaggaaagaaaagttcaagtcttgtggatatcagagaagaagaaacagagggaggcagtcgaagactctccctccctggattgttgtcacaagtttcccccaggctcttaagaaaggctgcacgggtgaaaacgaggacagtggttctgacccccacatacagtggagaagcagatgcgctcctgccttctctgagaacagaagtgtggacctgggggaaagggaaggaagggcagctggggcacggcgatgttctgcctaggcttcaaccgttgtgtgtaaaatgtctggatggcaaagaagtaatccatctggaggcaggtggttaccattctcttgcacttactgcgaaatcccaggtttactcatggggtagcaatacctttggtcaacttgggcattccgattttccaacaacagttcctcgtcttgcaaagataagcagtgaaaatggagtctggagcatagctgcaggcagggattattccctgtttttagtggatacagaagacttccagcctgggttatattacagtggccgacaggaccctacagaaggtgacaaccttccagagaatcacagtggttctaagactccagtacttctctcctgtagtaagcttggatatataagcagagtgacagcaggaaaagatagctatttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagtattgcacatctattacaaatttcctggttatgggaggattccagcttcttgctaagcctgccattgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcgtcgactgctgtgtgagagtagtaaccgagccctgtctctgcagcatgctgggaggttttccgtgaattggttcattctctttaatgatgccctggtccatgcccagttctccacgcaccatgttttccctctggccacgctgtgggcagagccactgtctgaagaagctggtggtgtgaatggcttaaagataactacacctgaggagcagttcactctcatttcatctacaccccaggaaaagacaaagtggctacgagctataagccaagccgtagatcaggctttgagagggatgtctgatctccccccttatggaagtggtagcagtgttcagagacaggaaccacccatttcacgcagtgccaaatatactttctacaaggatcctcgcctaaaggatgccacctatgatggacgctggctttcagggaagcctcatggcagaggggttttgaagtggcctgatggaaagatgtattctggcatgttcaggaatggcttggaagatgggtatggagaatacagaatcccaaacaaggcaatgaacaaagaagaccattatgtgggccattggaaagaaggaaaaatgtgcggtcaaggagtctacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaagggaacactgactatgccaaatggagactacattgaaggttattttagtggagaatggggatctgggataaaaatcactggaacctacttcaaacctagtctatatgagagtgataaagacagacctaaagttttcaggaagctaggaaacctggcagtgccagctgatgagaagtggaaagcggtgtttgacgaatgttggcgccaactgggctgtgagggcccaggccaaggggaagtttggaaagcatgggacaatattgctgtggccttgaccaccagtcggcgccagcacagagacagtccagaaatactgagtcgttcacagactcagacactagagagtttggaattcattccacagcatgttggtgccttctctgtggagaaatatgatgacatcaggaaatatttaataaaggcctgtgacactcctctgcaccccctgggcaggcttgtggagacactggttgcagtgtatagaatgacatacgtgggcgtaggagccaaccgcaggttattgcaggaggctgtaaaggagattaagtcctatcttaagcgaattttccagctggtgaggttcttatttcctgagctgcctgaagaaggcagcacaattcctctctctgctcctctgccaaccgaaaggaagtctttttgcactgggaagtcagattcccgatctgaatcaccagagccaggttatgtagtaacgagttctggattattgcttcctgtgctgctacctcggctctacccaccgctgtttatgctttatgctttggataatgatcgcgaggaagacatttactgggaatgtgtccttcgactaaataagcagccagatattgctctcctgggctttcttggggtgcagaggaaattttggccagcaaccttgtcaatccttggagagagtaaaaaggttttgccaaccacgaaagatgcttgttttgcctcagcagtagaatgtctgcagcagatcagcacaacatttaccccatcagacaaacttaaggtcatccagcagacttttgaggagatctctcagagtgtcctggcgtcactccacgaagacttcttgtggtccatggatgacttgtttcctgttttcttatatgtggtgctacgggccaggattaggaatttaggctctgaggtacacctcattgaggatctaatggacccctatcttcagcatggggaacagggtataatgttcaccaccttgaaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccagaaaaaaggactgtatagtttaaagggaggattgaaagggaggtaaaaaatcagattagaccagttcttggcctatgataagttccaaaaataccatttatctactatttgaaaaaagaagaggatatcccttcctacagtaaagggtatgtcagctacatgaagttgtaagaaaagcttccagtagagcttcttatattaaagaagttgatggatatttttgaatttctggtttgcctgaatccacctgcagttaccccgatccgtttgcaagaaccagatcgtacttgaaactatagtggccacactctgccttcctgagtcccttccagtcatgtgtgcatcatgtctctttgccaagggaggggagaaaggaacttttaaactgcagttttaactttttctaagctgtttcttgatgggagaggttctgtgcaaaactaccacattctgtccccaaaatgtggaatgcatccaaataggagtcttctgcctcttaacttaaaagaacataggaattttgtttttggtttctttatcatgctacagagagtgaatacactggaattcagacaccgactctgagctgctaggaacctcatttgtccatgtgcaaacgctgtattccaaggcctgtgaatggcagcctgaggaagttttgcatgcaggctgtgttttcgagcaggactaacaactgggaaataagcaaaaaactgcatcgatccccagcctggtgttgttcttccctatacttcacactgaactcaggatgggaagaaaaaggaaacaagctttggctttttccatctcaaaagtattgtggcacctcaacatttcagtgttttgctttttaaaaaatgccctattgtaagttgttggtttatactgtataagtaacactagtagctgttttgaataacataggtgctcttcctcatctcatctcctacaccgtggtgagcatacagagtgtcctgatttgtgttaagtgactgagaagatgttaattacttttgaaaaaggatcatggtttttgctctactttataatcaagacaagtgtttattaaaatactgttttggaatgttggctgtaatgtaacagcaattttcataataaaaggcattcatcttt

SEQ ID NO: 1021 - DNA, 3242 bp, Homo sapiens
  ENST00000439495
tttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagtattgcacatctattacaaatttcctggttatgggaggattccagcttcttgctaagcctgccattgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcgtcgactgctgtgtgagagtagtaaccgagccctgtctctgcagcatgctgggaggttttccgtgaattggttcattctctttaatgatgccctggtccatgcccagttctccacgcaccatgttttccctctggccacgctgtgggcagagccactgtctgaagaagctggtggtgtgaatggcttaaagataactacacctgaggagcagttcactctcatttcatctacaccccaggaaaagacaaagtggctacgagctataagccaagccgtagatcaggctttgagagggatgtctgatctccccccttatggaagtggtagcagtgttcagagacaggaaccacccatttcacgcagtgccaaatatactttctacaaggatcctcgcctaaaggatgccacctatgatggacgctggctttcagggaagcctcatggcagaggggttttgaagtggcctgatggaaagatgtattctggcatgttcaggaatggcttggaagatgggtatggagaatacagaatcccaaacaaggcaatgaacaaagaagaccattatgtgggccattggaaagaaggaaaaatgtgcggtcaaggagtctacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaaggataattctggcctcatagaacaagttgggaagtgttccctcctcccctattttctgaaagtttgcgaagctttggtattatttcttctttgaatgtttgggagaattcaccaatgaagtcttctgggcctaagcattactttggaacactgactatgccaaatggagactacattgaaggttattttagtggagaatggggatctgggataaaaatcactggaacctacttcaaacctagtctatatgagagtgataaagacagacctaaagttttcaggaagctaggaaacctggcagtgccagctgatgagaagtggaaagcggtgtttgacgaatgttggcgccaactgggctgtgagggcccaggccaaggggaagtttggaaagcatgggacaatattgctgtggccttgaccaccagtcggcgccagcacagagacagtccagaaatactgagtcgttcacagactcagacactagagagtttggaattcattccacagcatgttggtgccttctctgtggagaaatatgatgacatcaggaaatatttaataaaggcctgtgacactcctctgcaccccctgggcaggcttgtggagacactggttgcagtgtatagaatgacatacgtgggcgtaggagccaaccgcaggttattgcaggaggctgtaaaggagattaagtcctatcttaagcgaattttccagctggtgaggttcttatttcctgagctgcctgaagaaggcagcacaattcctctctctgctcctctgccaaccgaaaggaagtctttttgcactgggaagtcagattcccgatctgaatcaccagagccaggttatgtagtaacgagttctggattattgcttcctgtgctgctacctcggctctacccaccgctgtttatgctttatgctttggataatgatcgcgaggaagacatttactgggaatgtgtccttcgactaaataagcagccagatattgctctcctgggctttcttggggtgcagaggaaattttggccagcaaccttgtcaatccttggagagagtaaaaaggttttgccaaccacgaaagatgcttgttttgcctcagcagtagaatgtctgcagcagatcagcacaacatttaccccatcagacaaacttaaggtcatccagcagacttttgaggagatctctcagagtgtcctggcgtcactccacgaagacttcttgtggtccatggatgacttgtttcctgttttcttatatgtggtgctacgggccaggattaggaatttaggctctgaggtacacctcattgaggatctaatggacccctatcttcagcatggggaacagggtataatgttcaccaccttgaaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccag

SEQ ID NO: 1022 - DNA, 727 bp, Homo sapiens
  ENST00000489440
cagaggggttttgaagtggcctgatggaaagatgtattctggcatgttcaggaatggcttggaagatgggtatggagaatacagaatcccaaacaaggcaatgaacaaagaagaccattatgtgggccattggaaagaaggaaaaatgtgcggtcaaggagtctacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaagggaacactgactatgccaaatggagactacattgaaggttattttagtggagaatggggatctgggataaaaatcactggaacctacttcaaacctagtctatatgagagtgataaagacagacctaaagttttatggagtctcactttgtcacccaggctggactgcagtggcgtgatctcagctcactgcaacctgcacctc

SEQ ID NO: 1023 - DNA, 4895 bp, Homo sapiens
  ENST00000482891
gaatcagctgatcccgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcagcctcttttagaagaagcaattcctaatctccacagcccgcctaccacaagcacctcagccctaaacagcctggtggtctcttgtgcatctgctgttggtgtgagagtggctgctacttatgaagctggtgccttgtcactgaagaaagttatgaacttttatagtacaaccccttgtgaaactggagctcaggcaggcagtagtgccattggccccgaaggtttgaaagatagcagggaagaacaggttaaacaggaatcaatgcaaggaaagaaaagttcaagtcttgtggatatcagagaagaagaaacagagggaggcagtcgaagactctccctccctggattgttgtcacaagtttcccccaggctcttaagaaaggctgcacgggtgaaaacgaggacagtggttctgacccccacatacagtggagaagcagatgcgctcctgccttctctgagaacagaagtgtggacctgggggaaagggaaggaagggcagctggggcacggcgatgttctgcctaggcttcaaccgttgtgtgtaaaatgtctggatggcaaagaagtaatccatctggaggcaggtggttaccattctcttgcacttactgcgaaatcccaggtttactcatggggtagcaatacctttggtcaacttgggcattccgattttccaacaacagttcctcgtcttgcaaagataagcagtgaaaatggagtctggagcatagctgcaggcagggattattccctgtttttagtggatacagaagacttccagcctgggttatattacagtggccgacaggaccctacagaaggtgacaaccttccagagaatcacagtggttctaagactccagtacttctctcctgtagtaagcttggatatataagcagagtgacagcaggaaaagatagctatttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagtattgcacatctattacaaatttcctggttatgggaggattccagcttcttgctaagcctgccattgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcgtcgactgctgtgtgagagtagtaaccgagccctgtctctgcagcatgctgggaggttttccgtgaattggttcattctctttaatgatgccctggtccatgcccagttctccacgcaccatgttttccctctggccacgctgtgggcagagccactgtctgaagaagctggtggtgtgaatggcttaaagataactacacctgaggagcagttcactctcatttcatctacaccccaggaaaagacaaagtggctacgagctataagccaagccgtagatcaggctttgagagggatgtctgatctccccccttatggaagtggtagcagtgttcagagacaggaaccacccatttcacgcagtgccaaatatactttctacaaggatcctcgcctaaaggatgccacctatgatggacgctggctttcagggaagcctcatggcagaggggttttgaagtggcctgatggaaagatgtattctggcatgttcaggaatggcttggaagatgggtatggagaatacagaatcccaaacaaggcaatgaacaaagaagaccattatgtgggccattggaaagaaggaaaaatgtgcggtcaaggagtctacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaaggttggaaactagctttctttttttttctccctaataaattcttttactaatttttttttactttaaaaatagctgatttacatgccataaaattcacccctttcaagtgcacgtttcagtgatttttggtcaacatggctgtacaaaccaccaccacaatccagtttcagaacatttccatcgcccaagaaaatcccttctgctcattcagtgacttccatttccacctaaagtcccagccaaccactaatcacccttaatcactctatagatttgccttttttgggccttttgtataaatggaatcatacatgcaatctcctctatgtggcttcttacacttagtataatgtttttgttttttccatattgtggcatgtatagtatttgttcctttttatggctgaatagtgttccaaaactacattttgtttatccttttaccagttgatggacattgggttatttccaactttagactattgtaaataatgctgctataaacttttgaatgcagtttcttgtgtagacatatgttttcattttcatttctcaagtagatgcctggagtgtaattgctaagttgtatggtaaattgatgtttaacatattaagaaactgtcgaacttttttccaaagtgtctgtaccattttacattcccatcagcaatgtctgaggatactaatttctccatatcaaaaaatatttcttattttctgtcttttttcttatagccattccaatgggtatgaagtggtatctcctggttttaatttgcattccctagtgactaatgatgtagaacatgcttattagtgattcatatatcttctttgatgaaatgtctattcagatcttggcctatttctaaaattttgtttgtactcttgttgaattgtatgggttctttctgtattctggatacatgtcctttatcagatatgatttgtaaatattttcttgcagtctgacttgtcttttattttcttaatagtgtcttttgaaatagaaaagtttttcattttaataaactctataaaaaattttatgaa

SEQ ID NO: 1024 - DNA, 537 bp, Homo sapiens
  ENST00000494017
ttcctctgcctctagtgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcgtcgactgctgtgtgagagtagtaaccgagccctgtctctgcagcatgctgggaggttttccgtgaattggttcattctctttaatgatgccctggtccatgcccaggaatggcttaaagataactacacctgaggagcagttcactctcatttcatctacaccccaggaaaagacaaagtggctacgagctataagccaagccg

SEQ ID NO: 1025 - DNA, 505 bp, Homo sapiens
  ENST00000483703
ctattacaaatttcctggttatgggaggattccagcttcttgctaagcctgccatgtaagcaaacccacaccttccagttatcattctctccgccaaagatgacattttatagtgctctgttttcgagtgctcagggaaagctttgacttcatcattttaccaaacaagtcaaaatataaactttcatgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcg

SEQ ID NO: 1026 - DNA, 2981 bp, Homo sapiens
  ENST00000482789
gaatcagctgatcccgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcagcctcttttagaagaagcaattcctaatctccacagcccgcctaccacaagcacctcagccctaaacagcctggtggtctcttgtgcatctgctgttggtgtgagagtggctgctacttatgaagctggtgccttgtcactgaagaaagttatgaacttttatagtacaaccccttgtgaaactggagctcaggcaggcagtagtgccattggccccgaaggtttgaaagatagcagggaagaacaggttaaacaggaatcaatgcaaggaaagaaaagttcaagtcttgtggatatcagagaagaagaaacagagggaggcagtcgaagactctccctccctggattgttgtcacaagtttcccccaggctcttaagaaaggctgcacgggtgaaaacgaggacagtggttctgacccccacatacagtggagaagcagatgcgctcctgccttctctgagaacagaagtgtggacctgggggaaagggaaggaagggcagctggggcacggcgatgttctgcctaggcttcaaccgttgtgtgtaaaatgtctggatggcaaagaagtaatccatctggaggcaggtggttaccattctcttgcacttactgcgaaatcccaggtttactcatggggtagcaatacctttggtcaacttgggcattccgattttccaacaacagttcctcgtcttgcaaagataagcagtgaaaatggagtctggagcatagctgcaggcagggattattccctgtttttagtggatacagaagacttccagcctgggttatattacagtggccgacaggaccctacagaaggtgacaaccttccagagaatcacagtggttctaagactccagtacttctctcctgtagtaagcttggatatataagcagagtgacagcaggaaaagatagctatttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagcaagtatccagtcccgtgtcatgttcaatctctgcagggttattctgccaaggagaacagctccttaatcagaagagactagattagggagagtgatataaggtaatagaaattgcaaagcagtattttaatcttaagccaactatagttctggattgctaaaatttagtcttctctaaatgaaaaaaaatttaaaaataatgaattatcatgttttcttctatattctagcagagtgatagcataatttacattaaatgtactataataagtctggttctttagaaaacaattttgtttacttaactaaattgtactaaaacttggaagaaattagtaactaaacaaattatttcaagaccaactgctgattgtaaatatggagctgttctgatgtctgcttttgacttttatataaatggaagttttaaaagacccaactatttttaacatgaagatgtttttccttaataaaacctggaatagtta

SEQ ID NO: 1027 - DNA, 2677 bp, Homo sapiens
  ENST00000467448
gaatcagctgatcccgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcaggtacctgctcaattttataaaataaaagtgtgtctagagttgaactgtatgggcttttctttagaaactttaaaatgagtaaggcttggtagcattttttattttttgagtttgattataattttgttttatcaggcaagcctagataaaggaaagaacctggattaattcaaaatcactctttatgtttgttctggccctttatgatattgaaaggtgtcatgttgggcttgttttataagtaggagcatttcatttttttttcttgctagtactttttttctatggctaaagtactgaattttggtgggccctgaatagtttaatataactagagattcacaaagattcttcttacttgtgtttgtaacactcttcagaattctgtagagaaaagtcttttccttctttaacagggaagattgttttgtggcagatccttcaattgtaggcagatttaaaacttacaggcaattacatgtttcagtttttttcaattatagctgtggtccttactgggcttaatttgaagaggtggctaatattttatctttttgtttgtttgtttttgagatggggtcttgctctgtcacccaggctggagtgcagtaatgcgattgtggctcactgcagcctcgatctcccaggttcaagcgatcctcccatttcagccttccaagtagctgggactatacacatgccaccacacctgctgattttatttttaagtagagtagagcctgttgcccaggctcatctcaaactcctgagctcaagcaatcctcccacctcagcctcccaaagtgttgagattacaggcatgagccatcatgcccagcctattttatatatcttattaaaactattttcattttgaagatttgtggtagaatgaacaaaagttgtttatcagtagcacatggtaaagtttgagttcccgcttaaactaaattgttttaaaaggattatttctgtgttttactcttagtgtggccttttgattttgctttaccaaaactgtaagaaaacaaaacaaaagatcatactcataaaagatctgtcctgcagtgtttctttttaggtttttgaaaccacatagcctcttgattctcaattcttattgtttactctgtcagaatgtgaacatgaaggtatttttagaaatagtctttatttcacaatctattcactgaaacttgtgggtatttgaatttttaaaaaaatcaaggataagctgtttggagaaaggtattataaagtctgaacaaagcaaaagtagtagtttaacaagaatgcatgtagaaaattcttagactgtacatgcttatcacattttacttactttgttaaacattggaagtttttgttacttatgctagtaacaatgtgtgtgtttctattgaattaaatttaatttatttaaa

SEQ ID NO: 1028 - DNA, 768 bp, Homo sapiens
  ENST00000496244
gaatcagctgatcccgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaaggcatgaatagcaattcacaatgcatattataaaatctatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacat

SEQ ID NO: 1029 - DNA, 571 bp, Homo sapiens
  ENST00000409632
aagctcgcgccggatgcggagcgcggtgctgccggtggagcttcagcttatgtcttgatgtttgcctgcatgtagctgaactgattgatccaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattg

SEQ ID NO: 1030 - DNA, 559 bp, Homo sapiens
  ENST00000410052
agctgatcccgcggacccactgggttgccaagctcgcgccggatgcggagcgcggtgctgccggtggagcttcaggatggagaaggaactgactgctgtacccaagtgaagatctttactcagttacccttatatttggctatatggaataaaattgtgtgatatgtttattctgagcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtga

SEQ ID NO: 1031 - DNA, 491 bp, Homo sapiens
  ENST00000462747
ggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaaggaactaaaggaagacaaattctaggaaacaaggattaaatctggtcctggtggttgtatgggataaacatggatttctttctagtttgtcttatatcagttttattataatattattcttcaggactttaaaaacaatcttactttaaaagtgtgaactatattcaatacctgtcctatgagatttaaaatatatagttctcaagcaaatataagtggaat

SEQ ID NO: 1032 - DNA, 1769 bp, Homo sapiens
  ENST00000286190
caagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtgccctggagaagagaccaaataaatagacattggcatgatgtcctgcaacagcttcttcttatgcaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattcgcatctgaatttcacagcttatcacggactcttcactgaaaaatgatgctctccatactgggagctgagctttctctgagttttgtactatttttcttctaccttgacgtatttcgttagaaagaaactgatttgaaggccttcttcatattgaacttttactatatttgggaggtgtacctttgtcccctggggcatttaggtagcaaaaaaagatgatgtgttgatttta

SEQ ID NO: 1033 - DNA, 782 bp, Homo sapiens
  ENST00000415745
acagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtcatgcaggaagaattgcatgcacaagcccttatcctagagtcactgaacacaaacctctactatacccagttggaactccagaaagaggcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattcgcatctgaatttcacagcttatcacggactcttcactgaaaaatgatgctctccatactgggagctgagctttctctgagttttgtactatttttcttctaccttgacgtatttcgttagaaagaaactgatttgaaggccttcttc

SEQ ID NO: 1034 - DNA, 2075 bp, Homo sapiens
  ENST00000494171
aactcaggcccaagtcacaggaatctgaatggtggggtgaccttctcctctagtttaatttcattgcaatactgagaaacttcaactgttttgtctttagaagggaaattcatgtttgtgccaggccagcctttgtaaaagcctttgattggattcactagaagtctgtcttcccgcagtacatatactgtgaattttctccttcggcatttcaaccacttggaatggccactaaagtggcttttgatctaaagtaaactctgattctgtgttgatggggaaccatttctctctaacatggtggtttctttaagatgtttgacttgggccacatgagaataacagatctttgggcagtccaagcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcacaattacctccaaccaacaaaacctgttgtttccccaaaaatgaaaatccattcagcaaggcaagaagagactaataaatcattttatgtgagtaaaggcaggagagggcggtgggactaaaatttattgagtgcctactatgtgcaagcatgggccctttacatttttatacttaccttgtcgaatcttcacaaagatcctgggaggaggtgctgttaatattgcacattatgcacggcaggaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagagtccaggtgccctggagaagagaccaaataaatagacattggcatgatgtcctgcaacagcttcttcttatgcaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattcgcatctgaatttcacagcttatcacggactcttcactgaaaaatgatgctctccatactgggagctgagctttctctg

SEQ ID NO: 1035 - DNA, 1943 bp, Homo sapiens
  ENST00000392257
ctttggcctgccatctcccaagggcaaacctcacaactcaggcccaagtcacaggaatctgaatggtggggtgaccttctcctctagtttaatttcattgcaatactgagaaacttcaactgttttgtctttagaagggaaattcatgtttgtgccaggccagcctttgtaaaagcctttgattggattcactagaagtctgtcttcccgcagtacatatactgtgaattttctccttcggcatttcaaccacttggaatggccactaaagtggcttttgatctaaagtaaactctgattctgtgttgatggggaaccatttctctctaacatggtggtttctttaagatgtttgacttgggccacatgagaataacagatctttgggcagtccaagcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattcgcatctgaatttcacagcttatcacggactcttcactgaaaaatgatgctctccatactgggagctgagctttctctg

SEQ ID NO: 1036 - DNA, 1626 bp, Homo sapiens
  ENST00000439709
atagcaacaaaataaacaaactttggcctgccatctcccaagggcaaacctcacaactcaggcccaagtcacaggaatctgaatgcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattcgcatctgaatttcacagcttatcacggactcttcactgaaaaatgatgctctccatactgggagctgagcttt

SEQ ID NO: 1037 - DNA, 394 bp, Homo sapiens
  ENST00000494223
tatacccagttggaactccagaaagagaaagctatagtgggaaatctggagaaaatgcttcaaaccaagtttgctgaaactgaagaaaagtataagcacaccatacagatcctgacggaagagaacattcatctgaagtgcggctgctgctgaaaaagacatagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagttta

SEQ ID NO: 1038 - DNA, 430 bp, Homo sapiens
  ENST00000425488
atgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagc

SEQ ID NO: 1039 - DNA, 721 bp, Homo sapiens
  ENST00000448967
caagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagc

SEQ ID NO: 1040 - DNA, 458 bp, Homo sapiens
  ENST00000418364
ctcagtagcttcatctatagtatcagcataacaataattgagcagttttacctggctcacagcaaggactcggctatggcaaattttattttattttaattattttgttttatttttatttgtatcttattttattttttgagacgaagtctcactcttcacccaggctggagtgcagtggcacaatctcagctcactgcaacctctgcctcccaggttcaagcaatcctcccacctcagcctcctgagtagctgggactatagcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcac

SEQ ID NO: 1041 - DNA, 2013 bp, Homo sapiens
  ENST00000405148
ctttggcctgccatctcccaagggcaaacctcacaactcaggcccaagtcacaggaatctgaatggtggggtgaccttctcctctagtttaatttcattgcaatactgagaaacttcaactgttttgtctttagaagggaaattcatgtttgtgccaggccagcctttgtaaaagcctttgattggattcactagaagtctgtcttcccgcagtacatatactgtgaattttctccttcggcatttcaaccacttggaatggccactaaagtggcttttgatctaaagtaaactctgattctgtgttgatggggaaccatttctctctaacatggtggtttctttaagatgtttgacttgggccacatgagaataacagatctttgggcagtccaagcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtgccctggagaagagaccaaataaatagacattggcatgatgtcctgcaacagcttcttcttatgcaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattcgcatctgaatttcacagcttatcacggactcttcactgaaaaatgatgctctccatactgggagctgagctttctctga

SEQ ID NO: 1042 - DNA, 583 bp, Homo sapiens
  ENST00000527261
cttttttcatttttttcttcacttttctccagccttcctctctctctctccttccttcctccttgctttctttatatgccttatcttctgagaaggttgaccccagttccggcgatagacggacactaagccccccttgagtgactagaaaggcaggggacataggaacagttaggacataagggaagagtaaagagagggacccctgattttgatttcagggtgccctgtttgtctcatccaatatcctgaagacccaagatggagaccagctacttgtcccttccaaaaagcttccctggccttaatgtcagtgcttgtaggtgatctcagaaacctccctggtgaagaaaacctgaagacggggtcttgctctgttgcctggctggagtgcagtggtgctaacatgactcactgcacccttgacctcctggactcaagtgatcctcccacctcagcctcccaagtagctgggactccaagtgggtgccactacagccaaaccttcagacctgtagatgggctcttcttggacattctggagtccctgggggaaagggaagtctgaagctcagttggccac

SEQ ID NO: 1043 - DNA, 576 bp, Homo sapiens
  ENST00000532250
cacagagaggaggacatcagcatggagagactgcagatcagtcccagcaaacctgtggaggccagttaaatgcctggagctcatcccctgccattcaaacggggtcttgctctgttgcctggctggagtgcagtggtgctaacatgactcactgcacccttgacctcctggactcaagtgatcctcccacctcagcctcccaagtagctgggactccaagtgggtgccactacagccactgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccct

SEQ ID NO: 1044 - DNA, 256 bp, Homo sapiens
  ENST00000295663
acctcagcctcccaagtagctgggactccaagtgggtgccactacagccatggtgtctttaactgagatatgaagatcacaagcagagaagcttccgagttcagggaggaaatccagagttcggatttgagcatgttaagtttgagatctccgttagacatccacgaaggtcagaaccttcagacctgtagatgggctcttcttggacattctggagtccctgggggaaagggaagtctgaagctcagttggccac

SEQ ID NO: 1045 - DNA, 201 bp, Homo sapiens
  ENST00000532966
agagcctctctgcatgagataaggaaaggaatttatgtctgactttggagagattggatggagaagaaagaacagaggaaagagaagacagaaggaagacagaagaaccagaggagcataaccttcagacctgtagatgggctcttcttggacattctggagtccctgggggaaagggaagtctgaagctcagttggccac

SEQ ID NO: 1046 - DNA, 204 bp, Homo sapiens
  ENST00000527369
ctttggtctagagcaagtgttggcgaactattctgtaaagggctagatagtaaatgtctgaggttcgtaggatcatatggtgtctgtcacaactactcgactctgccattgcagtggaaaagcagccaaggacaatggaaccttcagacctgtagatgggctcttcttggacattctggagtccctgggggaaagggaagtctg

SEQ ID NO: 1047 - DNA, 527 bp, Homo sapiens
  ENST00000529835
gtggacggttggcgagggagtgtgtgtgtgtgtgtgtgtgtgtgtgtgtgtgtgtatccaagtgaccagaaggacgcctggaagaaaccaatgcttgcgggttgctgcaactacagggagcaagtcacctgtgcggggccgagacccccagagtctcgcgctgggaaaagttgtgcggggaggggaggacgtcggctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagatcactttggaggactatgagcaggcagccaagagtctggccaaggccctaatgatccgggagaagtatgcgcggctcgcctaccaccgcttcccgcggatcacat

SEQ ID NO: 1048 - DNA, 3806 bp, Homo sapiens
  ENST00000396554
tgctgctctcaagtttcccgttggcggcgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcgcggcctggccgggccctggccccggctggcctcagtgcccagcagccccgctccgctctgcccagcgcgtcccctttgctccagccctgcggccgtccctttcggccggcggcatggccctgtcgtccgaacccgctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaa

SEQ ID NO: 1049 - DNA, 980 bp, Homo sapiens
  ENST00000524866
gttggcggcgcggcccgggcgcttcaggtagcctctcggctctctctgctccgctccgcgcccagaggattgctcctgtgggtcacttgaggcaggctccaccttccccaggaggagtggcagagtccagccagcgctcggagctggaggcccacgtgggagcagtgagcggctctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgat

SEQ ID NO: 1050 - DNA, 2376 bp, Homo sapiens
  ENST00000534047
agtgcccagcagccccgctccgctctgcccagcgcgtcccctttgctccagccctgcggccgtccctttcggccggcggcatggccctgtcgtccgaacccgctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttaggcagcaggctgttggatccacctgacaagcgagtctttgctgtcccccagtgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactag

SEQ ID NO: 1051 - DNA, 3680 bp, Homo sapiens
  ENST00000396553
tcaaccctgcttggttttagaggattgctcctgtgggtcacttgaggcaggctccaccttccccaggaggagtggcagagtccagccagcgctcggagctggaggcccacgtgggagcagtgagcggctctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaa

SEQ ID NO: 1052 - DNA, 2248 bp, Homo sapiens
  ENST00000529834
agcgctcggagctggaggcccacgtgggagcagtgagcggctctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgag

SEQ ID NO: 1053 - DNA, 2753 bp, Homo sapiens
  ENST00000528723
attcacgagagaatttccagcccaggcttttcctgctctggctcactgctgctcacagatatgcaaaacagagacctcctactccagccggcagacaggacccagccagctgcacgcacgcactgactcagctgagcctcctgggtggcaggcagcacctcacccgggtgcatcacttgagtggcatcttcaggaccagtcatggagccaggctcagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctg

SEQ ID NO: 1054 - DNA, 3156 bp, Homo sapiens
  ENST00000529507
atagtctggaggagggagagctgaactctctcttgtcccttctcaaacatgggaacaaagtcaggagggcagggctgccaggtgctgcagattccctgagtttgggaaaatggaagcccacctagttgaacagttcattctttgaattttgaacacttgctttctcctgacacctaagtggccctacatgcttcacatccagttacttattgagctaattttgaaattggcatgctgggtttggtctggggcattcctaagtagacagctgaccccaagtaccagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttgg

SEQ ID NO: 1055 - DNA, 545 bp, Homo sapiens
  ENST00000531227
gtttgtacaagtagtttaggtgcaatgaaccactcttattggtcaaggagtggtgagaaccctcctgaaatctaggttcccagataccaggcaagggccaatcttgcaagcacatctttccaaggatggcagtctcaggcctgctgcatgaaccctttcctgcctgcctcccttctgcagatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctct

SEQ ID NO: 1056 - DNA, 531 bp, Homo sapiens
  ENST00000533116
gcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcggtgagtgagcttctgctccagtgccgccagcagacagcagccctggctggggactcagccccctggaaagccaccatgattgtgcttgccgggaggtgctacggaagcagctttctcttctatctgactgagaggtcatgcggcctcagagaataacagggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctac

SEQ ID NO: 1057 - DNA, 717 bp, Homo sapiens
  ENST00000530864
acgcattttgcacccgaggctgtgggagatgcagtgatggagtcttgctctgtcacccaggctggtgcgatctcggctcactgcaacctccacctccggggttcaagtgattcttctgccttagcctcctgagtagctgagattacaggtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatca

SEQ ID NO: 1058 - DNA, 593 bp, Homo sapiens
  ENST00000529744
ccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagc

SEQ ID NO: 1059 - DNA, 3994 bp, Homo sapiens
  ENST00000444303
gtggacggttggcgagggagtgtgtgtgtgtgtgtgtgtgtgtgtgtgtgtgtgtatccaagtgaccagaaggacgcctggaagaaaccaatgcttgcgggttgctgcaactacagggagcaagtcacctgtgcggggccgagacccccagagtctcgcgctgggaaaagttgtgcggggaggggaggacgtcggctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccgtttatatacatttgccctaacataggaagtattgtgtagtttctcattgtcattttatctgtatcaagtatctttttttaaattgttaaataaagtcagctaggactgtg

SEQ ID NO: 1060 - DNA, 5516 bp, Homo sapiens
  ENST00000312371
gattggtgctgtgacctgcggcagcacagccgcctgcgttgagcgcccacggtgggctggactttgcactaggtgctgacaggaccggcagaggtggccactgccctcgtccccagcctgcactcctgggcgaaggctgacgctgaacagggtgctgtgggcccagaagcgcccatgcctgagagcgtccaggaccaggcagagctgggccttaagggcccttggaccagtgtctgtctgcagggagcccccggtagccactcggatcagcccgagggaagattctggacgagaccgtggccgtcccccgggtggcccatggacagcagcaggggctcccaggagtggccaggccctgcccgcccaccatgctgcagtgtagacccgcacaggagttcagcttcgggccccgggccttgaaggacgctctggtctccactgacgcagccctgcagcagctgtatgtgtccgccttctcccctgccgagcggctcttcctggccgaggcctacaacccgcagaggacgctcttctgcaccctgctcatccgcacgggcttcgactggctcctgagccgacccgaggctcccgaggacttccagaccttccacgcctccctgcagcaccggaagccccgcctggctcggaagcacatctacctacagccgatagacctgagcgaggagccggtgggaagctccctgctgcaccagctgtgcagctgcacagaggccttcttcctgggcctgcgcgtcaagtgcctgccgtcggtggcagccgcgtccatccgctgctcctcgcggcccagccgggactctgacaggctccagctccacacagacggcatcctgtccttcttgaagaacaacaagccaggggacgcgctgtgtgtgctgggcctcacactgtctgacctgtacccccatgaggcctggagcttcaccttcagcaagttccttccagggcacgaagtgggcgtctgcagcttcgcccggttctcaggggaattcccgaagtcggggcccagcgcccctgatctggccctggtagaggcagcagcagacggccccgaggcccccctgcaggacaggggctgggccctgtgcttcagtgccctggggatggttcagtgctgcaaggtcacgtgccacgagctctgccaccttctgggcctggggaactgccgctggctccgctgcctcatgcagggtgcgctcagcctggacgaggccctgcggcggcccctggacctctgtcccatctgcctgaggaagctgcagcatgtcctgggtttcaggctcatcgagaggtaccagagactctacacctggactcaggcggtggtggggacgtggcccagccaggaggcgggggagccgtcagtgtgggaggacaccccgcctgccagcgccgactcgggcatgtgctgtgagagtgactcggagcccggcaccagtgtgtcggagcccctcacccctgatgccgggagtcacaccttcgcctcggggccagaggaagggctgagctacctggcagcctcagaggctccgctgccacctgggggccctgcggaggccatcaaggagcatgaacggtggctggccatgtgcatccaggccctgcagcgggaagtggcagaggaggacctggtgcaggtggacagagccgtggacgccctcgaccgctgggagatgttcacgggccagctcccggccaccaggcaggacccacccagcagcagggacagcgtggggctgcgcaaggtgctgggggacaagttctcctccctgaggaggaagctgagtgcccgaaaactcgccagagcagagtcggccccccgtccctgggatggggaagagagttagtacagcaggggctgccctacgtctccttccctaaggatgctggccagcactgtccagtagctgaggccactactgacctgccagggataaagaggaagggtctgcctgggtggtggctcaggcctgtcatcccatcactttgagaggccaggagtttgagaccagactgggcaacatggtgagactctgcctctacaaaagaaaaattaaaaaattagctggatgaagtggttcatgcctgtgttcccagctattcaggaggctgaggtgggaggattgcttgagcctaggaggtcgaggctgcagtgggatgtgatcataccactgtactgcagtctgggccacacagaaagactgtctccagaaaaaaaaaagttctttggagaagccacagaccacctgtcttcaggcgcctccttcaactcctgagtcccagccagccgctcccaggggcctgcacacatggagaggcctccctgatcctgggtgcttctcgtggagtacaagccggactgtgctgaggttgggacagagccccctcccctgcagaggcagaaggaagcagcgtgcgtcctgtctccttccaggctgtgggcctgcccttcagttatttatagctggagctggagaggctggctcagatgaggagtgaccccgggggcacacaggctccacactgccacccagcttccaaggctgagtctcctccctaacggggaagtgacggggttttgtctctatcatctcaggcgtcaaccacatgcacacacacactgtcacgttctgtggcgctaacagcatcctgatcctgacggacttcaccggggctctccaggcatctcttctgacaaacactgcaggaggtgagggtgtctgacgtgcactgagggcagaggcccccttattcctgaggcggctacagctcaccgtggggaagatcaactgtggtgatgtttttgggacagtttcttggcaaaggtggccgcgctgtcagtaccaagtagctggaggtggtgatcagatgatctgtctttcctttttttttcggtctagttctgtcagttgctgagagaggggtattattgccatggctgggcgtttgatctgtctccctttagttttgccggattttgcttcctgcactttgaagctcctttacgtccctgcacatttgattgttgtgtcttcctgaggaattgacccttttattgtcacacgtaccccctcagcctgtggtggagggtctctgggagagagacttccggttctgacagcggaatcccttcggagtgacgagggcggggtcacagctcgcgcaccctcatctggagagaggcaagaacagggcagcttggaccttttgtgggtgggtggctcacacggttatggagggcttctaagaaaaacaaaatacaaaactaaaactagaagggctatgcaggtgaggtgggctgaggcttccttgtgaatctgacattggtggaggccgactgaaggctcccggtcctggtcccactccgtgttgacttcagagaagcaaagatgcagctcagaagtagcattaggatcttcgtcccgttctcttttgcgtagcttcaaaaaggcgtaacagtgacctgggaggggagatgaagagctaggcctttcagaaagtgaccaatggaaggtgccggcagagcaccctgcagtaacagaaggtgaaagccggagcctggtggctgttgctgcaaacaaccacccaaaacttagtggcttaaaatcaccacagtctagctcatgaatctgtaacttgggcagagctcggtggagacggtttgcccctgtggctcgactggagtgttcgttcacacggctgccaagtggaatttggctgggaatctcaggccttggttcctgcccacgtgagactctccatggaggaggggcatcttcttaggaaggcagctgccataccgtgaggaaacccgacaaacagggcagccagagccagacagcaggctcctggtcccagtcccggaaaatgcaaagggacaagtatgtgttgatttcagagaagctcagatgtagcattaggaccttcatccatacccttctcttttgcatggcttctaaagggcatgacagtgacctgggaggtaactgtgccagaataaagaggggagacgaaaaaaagagggtcactttcagaaagggacctgggcttcctcacaatatggcggttgccctcctaaggtggacatcgggagggtcagatggaagctctgtggcctttcctaactcggcctcacgtcacagagcgtcacctttcctgcactccacggcggcagtgacaaggaccccaccccaggttcacggggaggggacgtggcagggaatgtgagacaacacaatattgctgtggccattcatgaacagtcagtcagccccactcggcgttcactgtggggatttggctggtgcacctgcgaggtggcctgacctgttttccgatttccttcatcttctgcaaaaggttaaccgctggagtgatgcgagattaaacagaggtgataaaaatagaatgcctggctcatgctgagggtgggagcccactggggttatgaccaaagcctcggcgctctctgtacccgtgtcctttgaccctcagctgtgatgtgtgtcccaaaaaagcgttttgaagtgggaaggagcaaaccactaaaaaaaactccttttatccgcagcgtttaccaacttgcagatgtcagtgaaattttttaagacagctgttagaaggactgttttgaaatgcaactttgaggaagagaaattggtttccctcctctcccccgtgttagccccaggttctgtctgtgctgtggtgaagagtgacttgggacagtcaccaggaaagacgcaaggcagaggagagagaatgagggctgccttctcgaggaaggtcacagctcacgaatctttctaaacttaagtgctgcagaagttgaactgagattaaatttagagatgatggtttccaagacacacagggccacggttctttcagtttttaaacacgtgcaaagtccactgaattgctttctcgtctcatctgtcagaagcccctgcattcacaaggatgggtcttccagcttgacgatgacctctcttcggagagcctcacccatcttggtaagccaagtcagcggggcctcatggagctaaaaatagtttcaggtcatgacagatgttatctgtattgctgtgtgtgcgatgagtctggggaagctaacacatgccttctgaagtggctagaatacacactcccacgtcacagccatgctatgatgaaggggtgagaagcagtgtcccctctgaggcaaatctctcttcaggcagccccgcagtcctcttccgaaatctcattcttttccctctcttcctccccaaaaagcccaaactcattgtcagagtggggagaggggagaagcagcatcctgactcctgtccatggtgtgaaccctgagggcacgggacagtgagtggagctctgccaccacccgtttccagagcatgggtgaggagggagggatgccgacctgttaatatttgcttcagacctttccccgatgaacgaaatctccaaaagccttaaacataaaatggcttagtcaa

SEQ ID NO: 1061 - DNA, 1862 bp, Homo sapiens
  ENST00000407112
gatcctcccggcccaggccgagctgcccacgctgctgcccggggctcggtgcccggcgcggcctctgccggctccggcgggcgcgggactgcgagggtgctgtgggcccagaagcgcccatgcctgagagcgtccaggaccaggcagagctgggccttaagggcccttggaccagtgtctgtctgcagggagcccccggtagccactcggatcagcccgagggaagattctggacgagaccgtggccgtcccccgggtggcccatggacagcagcaggggctcccaggagtggccaggccctgcccgcccaccatgctgcagtgtagacccgcacaggagttcagcttcgggccccgggccttgaaggacgctctggtctccactgacgcagccctgcagcagctgtatgtgtccgccttctcccctgccgagcggctcttcctggccgaggcctacaacccgcagaggacgctcttctgcaccctgctcatccgcacgggcttcgactggctcctgagccgacccgaggctcccgaggacttccagaccttccacgcctccctgcagcaccggaagccccgcctggctcggaagcacatctacctacagccgatagacctgagcgaggagccggtgggaagctccctgctgcaccagctgtgcagctgcacagaggccttcttcctgggcctgcgcgtcaagtgcctgccgtcggtggcagccgcgtccatccgctgctcctcgcggcccagccgggactctgacaggctccagctccacacagacggcatcctgtccttcttgaagaacaacaagccaggggacgcgctgtgtgtgctgggcctcacactgtctgacctgtacccccatgaggcctggagcttcaccttcagcaagttccttccagggcacggtcacgtgccacgagctctgccaccttctgggcctggggaactgccgctggctccgctgcctcatgcagggtgcgctcagcctggacgaggccctgcggcggcccctggacctctgtcccatctgcctgaggaagctgcagcatgtcctgggtttcaggctcatcgagaggtaccagagactctacacctggactcaggcggtggtggggacgtggcccagccaggaggcgggggagccgtcagtgtgggaggacaccccgcctgccagcgccgactcgggcatgtgctgtgagagtgactcggagcccggcaccagtgtgtcggagcccctcacccctgatgccgggagtcacaccttcgcctcggggccagaggaagggctgagctacctggcagcctcagaggctccgctgccacctgggggccctgcggaggccatcaaggagcatgaacggtggctggccatgtgcatccaggccctgcagcgggaagtggcagaggaggacctggtgcaggtggacagagccgtggacgccctcgaccgctgggagatgttcacgggccagctcccggccaccaggcaggacccacccagcagcagggacagcgtggggctgcgcaaggtgctgggggacaagttctcctccctgaggaggaagctgagtgcccgaaaactcgccagagcagagtcggccccccgtccctgggatggggaagagagttagtacagcaggggctgccctacgtctccttccctaaggatgctggccagcactgtccagtagctgaggccactactgacctgccagggataaagaggaagggtctgcctgggtggtggctcaggcctgtcatcccatcactttgagaggccaggagtttgagaccagactgggcaacatggtgagactctgcctctacaaaagaaaaattaaaaaattagctgg

SEQ ID NO: 1062 - DNA, 836 bp, Homo sapiens
  ENST00000485540
ctctgcatttccctcctttcctgggtgaggctgatgctgctggcctggagtcctggcagctgatttctcactggtctcctggcctctacccttggtccttgtccatctgtcctcctgacctgtgatctggtgtgtgcatcccttcaggggctgccctgggagctccctgctgcctctccagcctcgacctgcacccttgtgtgctactctgccccagccaggctggcattttgcagccatgcagcctggctctgtgtcctgctgtctgccccagccaggctggcattttgcagccatgcagcctggctctgtgtcctgctgtctgccccagtcaggctggcattttgcagcgaggtggctcggctctgtgtgctgcctgctcagctgcagtgcctggcgctaaccctagaagtccctgtccctgacctgagcgaggagccggtgggaagctccctgctgcaccagctgtgcagctgcacagaggccttcttcctgggcctgcgcgtcaagtgcctgccgtcggtggcagccgcgtccatccgctgctcctcgcggcccagccgggactctgacaggctccagctccacacagacggcatcctgtccttcttgaagaacaacaagccaggggacgcgctgtgtgtgctgggcctcacactgtctgacctgtacccccatgaggcctggagcttcaccttcagcaagttccttccagggcacgaagtgggcgtctgcagcttcgcccggttctcaggggaattcccgaagtcggggcccagcgcccctgatctggccctggtagaggcagcagcagacggccccgaggcccccctgca

SEQ ID NO: 1063 - DNA, 583 bp, Homo sapiens
  ENST00000480560
atatgcgattgtcactgctgtcctttcatctgtgcatgaatctttcctctgtgtccctcggtgtttgcccttttgaaaaagtcatgctttccatcccttttctaagcctgacgctctgcttgctgtcagggtaggtccacattggccttgttcacccagcaggccggtgtctgcgagtgattcccggggagagggtcccaggcgggcaggggcgtcgcagggctgacggtgctgctctcccaccagacctgagcgaggagccggtgggaagctccctgctgcaccagctgtgcagctgcacagaggccttcttcctgggcctgcgcgtcaagtgcctgccgtcggtggcagccgcgtccatccgctgctcctcgcggcccagccgggactctgacaggctccagctccacacagacggcatcctgtccttcttgaagaacaacaagccaggggacgcgctgtgtgtgctgggcctcacactgtctgacctgtacccccatgaggcctggagcttcaccttcagcaagttccttccagggcacgaagtgggcgtctgcagcttcgcccggttctcaggggaatt

SEQ ID NO: 1064 - DNA, 964 bp, Homo sapiens
  ENST00000489665
ccctcggtgtttgcccttttgaaaaagtcatgctttccatcccttttctaagcctgacgctctgcttgctgtcaggacctgagcgaggagccggtgggaagctccctgctgcaccagctgtgcagctgcacagaggccttcttcctgggcctgcgcgtcaagtgcctgccgtcggtggcagccgcgtccatccgctgctcctcgcggcccagccgggactctgacaggctccagctccacacagacggcatcctgtccttcttgaagaacaacaagccaggggacgcgctgtgtgtgctgggcctcacactgtctgacctgtacccccatgaggcctggagcttcaccttcagcaagttccttccagggcacggtcacgtgccacgagctctgccaccttctgggcctggggaactgccgctggctccgctgcctcatgcagggtgcgctcagcctggacgaggccctgcggcggcccctggacctctgtcccatctgcctgaggaagctgcagcatgtcctgggtttcaggctcatcgagaggtaccaggtgagctgggtgaacccagtagcttcagccacagctgggaactgaagcagcatctgaagtccctctcattctcccagcgtgagccggcggaccctgaagggaacactgagactgaccacagctggacttgcgccgcctcgtcctcttagtgaatgaggtcctcagaggcttaagcacgcgttagttatccaaaatgcttctgttcaggtgaatgcacaaagcgttgaggtaggtcaactgcattttgtacggtggaaaagtaataagcagtttgctttttgtattataatgaaaatgaaaacctttccttaaaggaaaggaagcataatctcagaaatctgaatccagggaatcccaaataacccccccaaattttaatccttgacattcataatcacttggattaaaatctaa

SEQ ID NO: 1065 - DNA, 544 bp, Homo sapiens
  ENST00000433945
gagccagggcctgtcagctggtctcatcagagctgaggctgccctcgaggtggggttctgtctgaatgcatctgagttttgctttatttctctgtaaactgtaggtgagctgggtgaacccagtagcttcagccacagctgggaactgaagcagcatctgaagtccctctcattctcccagcgtgagccggcggaccctgaagggaacactgagactgaccacagctggacttgcgccgcctcgtcctcttagtgaatgaggtcctcagaggcttaagcacgcgttagttatccaaaatgcttctgttcaggtgaatgcacaaagcgttgagcctcatttagggttagatacggtcatattaagttgatgggaaggagacagagccagcctgaatgtcctgggtgatgaggattgaagtcatggggtctaaaaaggttctggaagacgaagagtgggaacgacaaaccgagaggaggaaaatcatctgcaaataaagcctccattgctgatcccttctatctcagccacagcagctcaggagga

SEQ ID NO: 1066 - DNA, 4322 bp, Homo sapiens
  ENST00000517746
ttcctgtcaagtcatcttgtgaaaggctgcctgcttccagcttggcttggatgtgcaaccttaataaaactcactgaggtctgggagaaaatagcagatctgcagcagatagggtagaggaaagggtctagaatatgtacacgcagctgactcaggcaggctccatgctgaacggtcacacagagaggaaacaataaatctcagctactatgcaataaatatctcaagttttaacgaagaaaaacatcattgcagtgaaataaaaaattttaaaattttagaacaaagctaacaaatggctagttttctatgattcttcttcaaacgctttctttgagggggaaagagtcaaacaaacaagcagttttacctgaaataaagaactagttttagaggtcagaagaaaggagcaagttttgcgagaggcacggaaggagtgtgctggcagtacaatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggtgttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttagaacagcattgtcctctgagttggttaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagttttcagaaaaagaaatgaacataatcaagtaaggatgtatgtggtgaaaacttaccacccccatactatggttttcatttactctaaaaactgattgaatgatatataaatatatttatagcctgagtaaagttaaaagaatgtaaaatatatcatcaagttcttaaaataatatacatgcatttaatatttcctttgatattatacaggaaagcaatattttggagtatgttaagttgaagtaaaagcaagtactctggagcagttcattttacagtatctacttgcatgtgtatacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggaaatatatacaaaaagaaaattaatcatagtcacctgactaagaaattctgactgctagttgccataaataactcaatggaaatattcctatgggataatgtattttaagtgaatttttggggtgcttgaagttactgcattattttatcaagaagtcttctctgcctgtaagtgtccaaggttatgacagtaaacagtttttattaaaacatgagtcactatgggatgagaaaattgaaataaagctactgggcctcctctcataaaagagacagttgttggcaaggtagcaataccagtttcaaacttggtgacttgatccactatgccttaatggtttcctccatttgagaaaataaagctattcacattgttaagaaaaatactttttaaagtttaccatcaagtcttttttatatttatgtgtctgtattctacccctttttgccttacaagtgatatttgcaggtattataccatttttctattcttggtggcttcttcatagcaggtaagcctctccttctaaaaacttctcaactgttttcatttaagggaaagaaaatgagtattttgtccttttgtgttcctacagacactttcttaaaccagtttttggataaagaatactatttccaaactcatattacaaaaacaaaataaaataataaaaaaagaaagcatgatatttactgttttgttgtctgggtttgagaaatgaaatattgtttccaattatttataataaatcagtataaaatgttttatgattgttatgtgtattatgtaatacgtacatgtttatggcaatttaacatgtgtattcttttaattgtttcagaataggataattaggtattcgaattttgtctttaaaattcatgtggtttctatgcaaagttcttcatatcatcacaacattatttgatttaaataaaattgaaagtaatatttgtgcaa

SEQ ID NO: 1067 - DNA, 4353 bp, Homo sapiens
  ENST00000297450
gccctaagccatcagcaatccttagtataggggcacactcatgcattcctgtcaagtcatcttgtgaaaggctgcctgcttccagcttggcttggatgtgcaaccttaataaaactcactgaggtctgggagaaaatagcagatctgcagcagatagggtagaggaaagggtctagaatatgtacacgcagctgactcaggcaggctccatgctgaacggtcacacagagaggaaacaataaatctcagctactatgcaataaatatctcaagttttaacgaagaaaaacatcattgcagtgaaataaaaaattttaaaattttagaacaaagctaacaaatggctagttttctatgattcttcttcaaacgctttctttgagggggaaagagtcaaacaaacaagcagttttacctgaaataaagaactagttttagaggtcagaagaaaggagcaagttttgcgagaggcacggaaggagtgtgctggcagtacaatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaagttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttagaacagcattgtcctctgagttggttaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagttttcagaaaaagaaatgaacataatcaagtaaggatgtatgtggtgaaaacttaccacccccatactatggttttcatttactctaaaaactgattgaatgatatataaatatatttatagcctgagtaaagttaaaagaatgtaaaatatatcatcaagttcttaaaataatatacatgcatttaatatttcctttgatattatacaggaaagcaatattttggagtatgttaagttgaagtaaaagcaagtactctggagcagttcattttacagtatctacttgcatgtgtatacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggaaatatatacaaaaagaaaattaatcatagtcacctgactaagaaattctgactgctagttgccataaataactcaatggaaatattcctatgggataatgtattttaagtgaatttttggggtgcttgaagttactgcattattttatcaagaagtcttctctgcctgtaagtgtccaaggttatgacagtaaacagtttttattaaaacatgagtcactatgggatgagaaaattgaaataaagctactgggcctcctctcataaaagagacagttgttggcaaggtagcaataccagtttcaaacttggtgacttgatccactatgccttaatggtttcctccatttgagaaaataaagctattcacattgttaagaaaaatactttttaaagtttaccatcaagtcttttttatatttatgtgtctgtattctacccctttttgccttacaagtgatatttgcaggtattataccatttttctattcttggtggcttcttcatagcaggtaagcctctccttctaaaaacttctcaactgttttcatttaagggaaagaaaatgagtattttgtccttttgtgttcctacagacactttcttaaaccagtttttggataaagaatactatttccaaactcatattacaaaaacaaaataaaataataaaaaaagaaagcatgatatttactgttttgttgtctgggtttgagaaatgaaatattgtttccaattatttataataaatcagtataaaatgttttatgattgttatgtgtattatgtaatacgtacatgtttatggcaatttaacatgtgtattcttttaattgtttcagaataggataattaggtattcgaattttgtctttaaaattcatgtggtttctatgcaaagttcttcatatcatcacaacattatttgatttaaataaaattgaaagtaa

SEQ ID NO: 1068 - DNA, 1526 bp, Homo sapiens
  ENST00000520734
cggctaagtttttgtatttttagtagagacggggtttcaccatgtttgccaggatggtctcgatctcttgacctcgtgatccacccgccttggcctcccaaagtgctgggattacaggcgtgagccactgcgcccggcggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggtgttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttc

SEQ ID NO: 1069 - DNA, 1523 bp, Homo sapiens
  ENST00000520052
cggctaagtttttgtatttttagtagagacggggtttcaccatgtttgccaggatggtctcgatctcttgacctcgtgatccacccgccttggcctcccaaagtgctgggattacaggcgtgagccactgcgcccggcggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaagttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttc

SEQ ID NO: 1070 - DNA, 813 bp, Homo sapiens
  ENST00000518386
agagctaccaccaacaacagtgtccttcagaagcagcaactggagctgatggacacagtccacaaccttgtcaatctttgcactaaagaaggtgttttgcaatatggatgtcaatgggggaggttggactgtaatacaacatcgtgaagatggaagtctagatttccaaagaggctggaaggaatataaaatggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgata

SEQ ID NO: 1071 - DNA, 1177 bp, Homo sapiens
  ENST00000521950
aaacagagctaccaccaacaacagtgtccttcagaagcagcaactggagctgatggacacagtccacaaccttgtcaatctttgcactaaagaagttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggtaagtcatgctacagtgtagtgttcgactaccttttacctagccacttaataattgtagtgggaaaatatgaaaaaaagaaatgaaaatcatccttcaaaatgaaaattcttttttttttgtctagacctattacaaagaggtacaaaaaagcctgtaaagactttttcaaagatttaaatttcagttttcgtaggttgactatctttgatattggcttaaattttagggaatggtgaatgaagtcaagcatactgttgttctgtggttatcatgcagttgcagtgaattcatatatataaaactgataagtttcatactcaaactcattggcttaaataatctctttattctaaaaaaagattttctggttctactttttttgatgacctttcttgaattagcatttttcaaatgatcttgaagatgacaaaagtaaaatttttttatgtttgaatgatttacataaaagagaagatgaggcatgatttagagggttttcttggtaaatctaaaaagcaaaaataaattgtaataatggcatcaatatacataatacatgattgcagatgtaaaaatagataaactatacacttaatgatacatgtttccaattatcctttttcaatgagaagctcgtctactagggaaaaataaacacacaaaaatatggctaaggaaataa

SEQ ID NO: 1072 - DNA, 1936 bp, Homo sapiens
  ENST00000522400
gtcactattgaaacttggagatgtttgagtacctgacccatattttatttataataatacccccagttgtaagtgaaaactgatgcccaagaatggttgttgagtaaatcaaaaaataaatgaataaatgaagtagaattacggaaaataaaagtgtagctcgaggttatgttgactgagagcaggtgcagaaattaaaggaatagtggtggtggggactactgggacaggaatcaacatttcaaatgtacaatcttggaggtgagtcaattcctagggttaatgaagacatactgtatgtgtggctgttgtcaaagtagggcgagagccttgggaggagagttgtcctatttcatatgcccacaagtaggcatgtatatcttggacccttccactctgaggaagtacatggacaattcgctctttgaatgacatttcttgccactgcttttataccctttttgctacttgtgttccaaatgcaatgcctcagggaaaacacttgaggttttttctttaatcagggcttagctctgtgtcctcatagcctgcttgctgctgttgcatcatatcccacctttagccaagcttcaacatgctttagtattcagttgttgaggaaatagtgtttcccatagtccccgttgaataatcaagctgccacattcatgctacatcaattacagtgattgctctccgacgataatcccattacagatatgtttctcttcttgggtagaccctgggggaaatgagtcaatttctaaataaataccattgtattttgaataattaaaatatgcataagtctttgaaagatttgtataaattttccacatgggaaagaagttattgtcacagtcagaagagatacaatatgtcatgttctcctgttattgttcgtgactaaaatacaagcaaataatatattctacatatgctatgccacaaatgttgcctctaatgaaatattgactcaaggatatctactgtaacatgtacatatataagaattgataggcaatgaaatatgtgatagttaaagacattatattttaaaaattttttattcttattgtactcccatttcaatcaatttaaagttttaaaattctgagtcatgtgttttggcaatcaaatggtctgtaactttggaaatttggtagcatttccaaaactttgaacatactcaaatgcttattttcatttaaaacaaagattttttaaaatgttgtatagtctgagacaaagacttaattttcagctgactaaaatttgtgcatgtaatttattcatcattgatggaatttaatcagaaataactcaaatatgaatcagaggaagaaataaccaataatatatctaaattaacattgttcaatatagtaatttcggtttttgtaatctgcagacctgttcgccttattcctattttgaaacatgtaggatatatgttttttaaagtagaagtattttttacttgactttgttttccatttgtcaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggtaagtcatgctacagtgtagtgttcgactaccttttacctagccacttaataattgtagtgggaaaatatgaaaaaaagaaatgaaaatcatccttcaaaatgaaaattcttttttttttgtctagacctattacaaagaggtacaaaaaagcctgtaaaga

SEQ ID NO: 1073 - DNA, 548 bp, Homo sapiens
  ENST00000520033
tattacttctattttgattccaagtagttgccataggaagaagcaacaccctgcagaaactgaggctatcagtgtatgtaggtgaaattaatttatccatttatttggcaaaataattaatcaaagcatagtgattattatgcagctcatggcatcgctatcaggaaaggttttgaggcagaatagatgtgttatcaactctaaatgaagctatatgataattatgttaatccatcaccttccatgaagggaaacctccttcctcaacttttctggtcttgcaactgaacaggatgagaagcaaggcatgcaagggggcaaatgatttgtgggtcaccataaatactggaactgttatggcactgctttcttgatgtgatggatttaattcaaagaaatcaactttccataatcacttgtcgattaaaatgagcttgagaattacattgtggaaaacatgaagtcggagatggcccagatacagcagaatgcagttcagaaccacacggctaccatgctggagataggaaccagcctcctctctcaga

SEQ ID NO: 1074 - DNA, 2805 bp, Homo sapiens
  ENST00000371129
atatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagaccttctccagaccgtggaagaccaatataaacaattaaaccaacagcatagtcaaataaaagaaatagaaaatcagctcagaaggactagtattcaagaacccacagaaatttctctatcttccaagccaagagcaccaagaactactccctttcttcagttgaatgaaataagaaatgtaaaacatgatggcattcctgctgaatgtaccaccatttataacagaggtgaacatacaagtggcatgtatgccatcagacccagcaactctcaagtttttcatgtctactgtgatgttatatcaggtagtccatggacattaattcaacatcgaatagatggatcacaaaacttcaatgaaacgtgggagaactacaaatatggttttgggaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataa

SEQ ID NO: 1075 - DNA, 373 bp, Homo sapiens
  ENST00000482591
tgtatattcagtatcattttaaaaaacagatttatattcttttatcagctcagaaggactagtattcaagaacccacagaaatttctctatcttccaagccaagagcaccaagaactactccctttcttcagttgaatgaaataagaaatgtaaaacatgatggcattcctgctgaatgtaccaccatttataacagaggtgaacatacaagtggcatgtatgccatcagacccagcaactctcaagtttttcatgtctactgtgatgttatatcaggtagtccatggacattaattcaacatcgaatagatggatcacaaaacttcaatgaaacgtgggagaactacaaatatggttttgggaggcttgatg

SEQ ID NO: 1076 - DNA, 751 bp, Homo sapiens
  ENST00000493994
ggatcacaaaacttcaatgaaacgtgggagaactacaaatatggttttgggaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggtatctttttctgataccaatactttattttcatatcttcaaagtatcttcccacattattagctattatctgcaatgacaacttttaaaaatccgaatcccaaataagcgttttctctctagacgaaaacctcttaactataatgaaagtgttcattctagttcaatcaggtattttacctctaatcttcctcagattttctattttttggtagtgtatagattatttatacagattatttaaaattgggacttatacagattatttaaaactgggatacatgcatctaaaacactgtaatatttataagaaaggaagataaacttacggggaaatacagtaacagtaactacatacgagtctgtacccattaaattgcatatctatctcctttaggaggctggtggtggcatgatgagtgt

SEQ ID NO: 1077 - DNA, 1591 bp, Homo sapiens
  ENST00000504806
ggtttccgccgagctggagcgcgcgggccacggcttctctggggacgcagaagcgagaagcggggacctcggcgcgcgccccgcgtcccgctcttcctgcccgcgccccggcccccggcccgcgccccggccgccggcatggtgctgctggccgggaccgggccggagggcggcggggcgcgctgcatgaccccaccaccgccgtccccaccccggggcgcgcaggtcgaggaggaccccgctgactacgaagagtttgaggacttctcgagtctgccagacacccgcagcatcgcctcggacgactctttctaccctttcgaggacgaggaggagcacggcgtcgagagcgcggagagcgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcaggaccggccttattgtcgcctgctaccacggctttgtggataccgtggtggccttagcagagtgcccccacgttgacgtcaactggcaggacagcgaggggaacacagccctaatcacagctgcacaggcaggggctgcccctgtccccatgggcatagtttccttagacactggctcccaatcttgcgcctccggcgtcagcatcacctgggctggctcatgtgagcattaacacagatctggtggaaacacagactgccaggccctgcccctggagtctttctttgaataggcctggggtggggcccaagaatgagcagatcaacaggtttcctggtgaggctgatgccactggcccagggaccccacattgaggatggagagctttgaagattttatgcctgatgacggcaaaggacccctctcagtgggcactgaagaccagcagagtcacagaccccacgagagatgttgtcagacagacacagaggcatcacggaattaaagtgaaaatgaggaaggcaggtgagcatgtgttcatgactttcctgtgctgttttgccaaagaggctgtttaggcccaatcagggcacgctatcatcactaactacttgttgaactatttccctggtcttgaccttgaaaggaggaacgcgttcgggttcaccgccctgatgaaagccgccatgcagggtcgaacggactgcatccgagccctgatgctagcaggggcggatgtccacgcgagggacccccgccgtgggatgtcgccgcaggagtgggccacttacacgggccgcgtggatgccgtccgtctcatgcagaggctgctggagcgcccctgcccggagcagttctgggagaagtaccggcccgagctgccgccgccccctgaagcggcgcggaagcccgcgggctccaagaactgcctgcagaggctcacagactgcgtgctgtccgtgctgacgccgcgctccgtgcggggcccggaggacgggggcgtcctggaccacatggtccggatgaccacgagcctctacagccccgccgtggccatcgtgtgccagaccgtgtgccctgagagccct

SEQ ID NO: 1078 - DNA, 9188 bp, Homo sapiens
  ENST00000296657
atggtgctgctggccgggaccgggccggagggcggcggggcgcgctgcatgaccccaccaccgccgtccccaccccggggcgcgcaggtcgaggaggaccccgctgactacgaagagtttgaggacttctcgagtctgccagacacccgcagcatcgcctcggacgactctttctaccctttcgaggacgaggaggagcacggcgtcgagagcgcggagagcgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcaggaccggccttattgtcgcctgctaccacggctttgtggataccgtggtggccttagcagagtgcccccacgttgacgtcaactggcaggacagcgaggggaacacagccctaatcacagctgcacaggcagggcacgctatcatcactaactacttgttgaactatttccctggtcttgaccttgaaaggaggaacgcgttcgggttcaccgccctgatgaaagccgccatgcagggtcgaacggactgcatccgagccctgatgctagcaggggcggatgtccacgcgagggacccccgccgtgggatgtcgccgcaggagtgggccacttacacgggccgcgtggatgccgtccgtctcatgcagaggctgctggagcgcccctgcccggagcagttctgggagaagtaccggcccgagctgccgccgccccctgaagcggcgcggaagcccgcgggctccaagaactgcctgcagaggctcacagactgcgtgctgtccgtgctgacgccgcgctccgtgcggggcccggaggacgggggcgtcctggaccacatggtccggatgaccacgagcctctacagccccgccgtggccatcgtgtgccagaccgtgtgccctgagagccctccgagcgtggggaagaggcggctggcggtgcaggagatcctggcggcgcgggctgcacggggcccccaggcgcaggaggaggatgaggtggggggcgcggggcagcgcgggcggaccggacaggaggacgcggactcccgggagggctccccgagagccggcctccctcccgccctggggtcccggggccccgcagcgcccgccccgcggaaggccagcctcctgcccctgcagcgcctgcggcggagaagcgtgcggcccggtgtggtggtgccccgggtccgagtcagcaaggcgcccgcgcccaccttccagcccgagcggccggcgcggaagggcagcaccaaggacagcggccacctgcagatccccaagtggcggtacaaggaggccaaggaggagaagaggaaggcagaggaggccgaaaagaagcgccaggccgaggcgcagaaggagaggcgcactgcgccctggaagaagaggacgtgagggcccgtgtgcctggcgctggggccggggctggggccggggcggggccgcagggctgggcgcggagaaggaggcggccccgttgcgcatcgcaccacttccgctccatggaccacggggctgcgcgcatttccaggctgtttgtccaggctgcttccaagagagggctgagggagccacatggattcgcttgtcgccagccctcctagcaatcagtacacctagcgggcacgttgcctaaaaggctccctttagagaacctcaattaagattttttttaaagatcaatttatcaaagggcgttttctccgtaattttgtatttttaatcattatttatcaaatttgcaacgttttacaagtgatagggccccttatatccaaggcagttttaatacacttgcctgaagaccttttgtttaagatactgtttctagcaataagtatccatgatacctgtatgagttcacacagacatcatgggattctcccctttttggctgtttggtcttttctcctcatcgtgggtgtaggtgcacactggatgttcttagtcattagattaagtgttgccggatatttctatttgacggaggcattggctcgttgagccacatgatcaagtgagacagaggatcagatgttactgtatctttttaaaactcttatccatatagtaatatattgaggaaaaacatattgtcaaattataaaacaatggagcgataaacatgtatttattgctagaattaaactcattttaagcaaggggttttaggtaaactggatacgaaatctttaacattaaaaatagatatgagaaaaaaactgtcattcgataaaatgaggcaaatttaataataaatgattaccagaaatacaaaattaagccatatgtgctcttaagtaattcgaatccagatatccttaaaatgtcaaaaagatgcaacaagagtcaggagcccagaatgacgcaaattacaggaatggggaggaggtgatttttagaagaggtgagagaatggaatggggaacagacttgttttcggcaaattctcctggagtagactgggcagccccctcctccaggctcagttccaaagagtccgttgtgtggatatttcttttatttttcctttgaggactgcgcttggtgtttagttcatccttatgccgacctcttagaatttccaagatgcagggccttgggcagggcagggcatgggtgtgatttgccttgggccacaagctcttggtgagagtcttatgtccacacttttatctccaaagtgacatggagatcacttttctcagtgatcaaatttgaatttatcaaagggggttttctgcataattttgtatttgtaatcattatcagatttgcagcattctaattcggcagggcagggtatgaaagctggaaactcaggctggagtttctagttctaatggctctctggccatgtgggttgtagagtgtctgtcacatatgcactttatttcagtattaattgaaatacttggacacgcacgatcacaggcctatttggaggctctgtactatgaccctaataaccctagatacatcatgatacatggtgtctgtctcaggatgcaggcagggctggtgcaggcttctccatactcccttccacttggcaccagcaggcatcgagcaaccagggatcttaaactggcctctccaaatactccattgaacaggactgcaggctgcacccaggctaatgggagattggtgtgttgatgatacagtgtttaagatgagattgcagtgagttcctccttaatcccagaagggcaccatgatgaatgccacaggagactggaccctctttgagaactgcagatattagttgactgtgggtcaccctcgtggccaaggagttgggattggccatgtcttcttcgaggaggtggagactgtaactgacactggttatctttggggttgtctttcctgaatcctttggcatgtggcaccttcctgccacatgtagataattcacggcattaccaagtcaccacgagccccaccctcacctctgtcaaccgaggacccagccaggcagtgccatgtggtctcccaggcacgcttctcaacaccggctacccctgctgtgaaggttctcaaggccctggtccggggagccaagccctgggagcgccctaaagctccgcaggtaactgcactgcagcccgcattgagaaccgcagctctaacacagtgattgcgagaggacacccattctgagctcccacagagggctccacctccccaagaatgtctcattgtcattggaacagccagggtcaggcagcttctgctcggactgacgtggcgtctgacccttggtgggttgccagacattcctgcctgtttccaccatgggaagctgtcactgggaatggtatggagccctcacttctaccccaagcctgggtgtctgctgcctccatgtcaaaaatggacatttctggtcctgcccagctgctacctcaccacaacccatgctcagagttgtcagggatgcgtggaacagcaatgatgggacagcaaatgactggcaatttccccaggtcccacgctgttctggagtggacgtgttgcggccctgcccccgatgtgttccagcctcatccaggtgcacaggatactctggggccagcacagggattgtccagtgatgctcctggtgtccacaaaacagctctagagatacctgcattttgaaaagcctgctgagccaacaagcttggggcaggacacggatttctttggcaaatctgcaggcgagctgaccacttgcctggtgagtggaagctgccattacctggccagtgtttgcaactcgagggaaaatgacagctgcatggggggaagcctgacctcccggggagctttattgtggcctcagtggaaagattggattttgaaacctgccagacccaactgaaagaagggtcattcctgattgagttggagactctccccagtccctctctctggactcattctagctgtggcctgcctgtggacagcccttccctttggcccatgcggcgggtccaggcagctcctgcagctgtgctcatggctgctggcccagaacttctcatttttgccatgtggaagcagatttgctagtagaggaattttccaagtcaagggaagtgttgccaaacctcttgcctcgacctgtggggggccttctgctcttgttttctcattctctttggagtgggcacagaggggacaagtcggcccccagtgaggctcagggagtgcaggagaccagggagggaagcccagatgatggggaaacagagccaccttgagggggtgtcatggggtcagtgtcagggtgatctgacgggtcagttcatacttaagcaacattattctgttcgtttcttttgggtaaggaattcctcatgggaggtgtggtcatctggtcgtagaggtggacagaaacaccccctcgtcttcctgagccatttggaagccctttcctctagccctaggtactggtgacacaggcccctcggtctcaggatgtggacagggctgggaggtgcaggcttcttgtcccatccccactcagtatcatcgggtatctggtagtcaggggtctcacagtggcctctccaaaagcctggtgtccttggagaacatttttcattttgtctgttttcgttgctttgaacagctgcattcactcaccgagggctcgccctccctggatctgccatgtggttcagggaggaggggaccgatgagcaccgaccccttctcttcacctgtcagtggccaccacagtgccccctctggctttgccaccacgttctcctgcccccgtcaccttgtctcttctaactcattagcctttccttcctttgtctgttttcttctcccagctggtttaagttcttgatcatccctggcaccacctaccctaaggtcttccaagaacagaaaagccagggcctgtgtggggcaatgtgttgtccctgtcgggttatggtgggacctcctagaccccagagtgaatgaatggcaggcctgccagtgactgtgctgatggcttagaattcctacacggctgtgcctctcccaccccgtcctctttgctcggaagggagacctggtttgctctcctccatgacagcccagcccctgctgtgcacaggggtggggctcgggatccctccctgcaccctgatgtttattaactgtagatagtgaatttcaagttgacaggtaccttctcagggatttatatataaatatagttagaggaaaagttgaagtctattttactactttttagtgtttgagtaaattatgctttaactggacagaagaaatatttctcagacaatgtcgatgctgctgatgacaactgagatgcctggagctcacccttgatggagacttccttggtgattggagatgggggactctggtggcagaaatggctttggggtaggtgtgaagttgcttcagtccctctgagttgcctcttctggatggaacgtgtgtatcaacaacaatgaaatgcacctccgtgtgcatggaggcggctgatgagaatacagataggccagtcctcgctcttccctccagaaccggccgctcccggtctgacgttggagcacgtgaactaagagtgacaattttttctacttgcttctgtgaataaagtgttctacagtcagcccagcactaaactcaccagaaaagaggagggaacagcacggagccattcatctggaattactcgatgtgcagaggctgccccttggccgcacttgggaacatcgtggacatcttccttcctctcaggctcctcctgacagactcctggcagcactggagacctcaggactatggagatcagaattgtaatggctttgtcatctcagtgtggccactcctgaggcaagaggctcctcctgggagcaggagagagagagtttgtgatgttggttggaaaataggatttatggatgcaggagggccgtgctaggcccctctgcccgcttctctccctgctgttggcggtgaccaggtctcaggagcggagacgaggctgttgtgagtgaaacagaagcccctggcatagggccagaccctaggcctgaaaaggatgcaaagcctgctgttttcaggctgttgggaagaatcgtgcgtaccgagtgattatgatgaaacgtatcccagagaggaaatgaatgggacctgaaaagtgggtctgccacatccctggtagcccgcctccaagagcactacactccccccagccccaccggccacactacatgacgtgggaaggctgtccgttcatccttaccctggggactcaagtgtgctctgcggagtgagtcacagccctgatgtgcaccctgcactactctttccccaggtgcgccggagacgcaggcttgctcatttccgtcctgacacagctcgctgttcctgcggtggtcagagtccccctgtgctgtgtcagctcctggacactactagtctttcacatgataaagcgcgagcactttttcgcttttgcagtatttggggaaattctaacacatttcccggggatttgcccaggtccctccacctcccacggtgggtaactgtgtggattctgcacctggcaatcggcgctcccctttggaaacacctgggggccctgtttcttccagcctggtccttggtttctaccccagccgctttcagccggcacctgcatgggactgcctggagggccacggtccagggaaggacaggtgggaccctgaccatgacagatctttctaaaacaataaagtcccattgatgacaactgcagtgggatgaatgccattgcagcggtcatgctgggagctgccgagagcttacaacaaaagcagttcctctcaagacactgcttgcatcttccctccacgcctctcggtgcatttggaacttgtttatgcgctggtataactcgagtcagctgcttatttctgtgcccttgcactcacaggttccttcattaacattttaaataagtggctaaaaaaactcctctggaggttgtttttgaaagagacaggaaaaagaaacacacagtacctggattgttttgacttattttcaagcgactcagctgaaagccggtgttgcatacacaatttcctcacgctgacccagcctgactaagacttgataaaaggcacagcccttggcagcaggcagtgccaatgtggacagtgtacactaagctgtgagtgtgtgcacgggcgagcacatgtatgtgtactcatacatccagatgaactaaagggacactgggctttgtgctggcaaaggttacgatgctgctgtagcttggctgtgggccccaggcagtgtcagatggaacctgctttgatggcgtgttgttcagtgtactcagtggggtctcacatggcccgaggacccactgtgagcactccgcccgctgtggcacagaacacggctggggtcatcacagcccaggtctttattgaaaggcggctcatatagaacccatttggccaggtctgggccatctctctgcctctgccctatcttggctgcctggaggggcccaggcccaagaggattctttacccctggaagagctccccaggcattcagcctatggcccttgacatttggctgcaggttaccgtcagaatcaacaccatatcctgaggaagccctggtatttccccaagtctgcctatgtattagacactctaatcaatgctaacacagttcagtttttgagggaactagttttgtcataatactacacccctctattgtttttaaataagaaaaaaaaaaaccccacgaaactttccatcaaagcaatggtccgtgttggcctgatgctttaagaagtttgaggaggtaggtatggaggcaccttaacaccagtttttgagcagaagttctagaagctgatttagaactacacagctatggatacacctgatgaaaaccgcaaaaggcgatgacaggcccagaaatatgaccagcaagcccgtgagcctttggggcatccgactgaatttgaaaataataccccattcagatgaacattaaaagccaatgtactggaattctctttgttctgcccgacatttgggggtgtccaaggacctgtgtttttaacaaagatgactttatgaccgttctaaggattgaacagattcctgcacagggtgccaggtttcaagttaggtcctcttagtataagctctctttttttctgaatgtaaacctatttgcattgtcatttctaataatccagtaggtttctggatattgtaaagatactgagtacagatataactgtgtaaatttcatagtgttttattttgaggtgagagttttgttatagtttataaaagatattttcctattcagacctcagggctattttgggacctacaaataaatgtgattcccagcagcttcaatttttgatattcaaaaagttaataatctttaagctaaatataatgtgatatgattcagaaaaaaatgtttttcccttttaacttctaacaaattatgtatctaatgtttaaaaaatatggaaaaaagggataatgtaaaaatgtgggagaattgtggctaaagaataaaaaatcacttgttaaaacgca

SEQ ID NO: 1079 - DNA, 649 bp, Homo sapiens
  ENST00000507479
agcggcttcaccagccccgcgggtccgaatcgcacgcggccgggtccgctctcccgggaggagagcccggcgtggaccagcgtgacgaccccagcgtgctgcggcctctccccgagggcccctccacaagggtccctgcgcgggccgggctcggccgttgccactcgggacagccatcccctcgagttcgcgctcgccgtccccgccttcacctcccgggttgggaggcgggcgactgcgcgcgaggtaaaggaacttgcgttccccggcgccgaggcggcagcagcgcagtgcacagcggcttctgaaggcggcgtcgacggggagctgcgcgtggctcccagtttcctggttacgtgcgcgccggcagagccaaaacctgcagccgaaactcccgcttctccgtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttggaagcctggagtgcctaagcctgcttgtagccagtgatgcccaaattga

SEQ ID NO: 1080 - DNA, 605 bp, Homo sapiens
  ENST00000507753
ccgaatcgcacgcggccgggtccgctctcccgggaggagagcccggcgtggaccagcgtgacgaccccagcgtgctgcggcctctccccgagggcccctccacaagggtccctgcgcgggccgggctcggccgttgccactcgggacagccatcccctcgagttcgcgctcgccgtccccgccttcacctcccgggttgggaggcgggcgactgcgcgcgaggtaaaggaacttgcgttccccggcgccgaggcggcagcagcgcagtgcacagcggcttctgaaggcggcgtcgacggggagctgcgcgtggctcccagtttcctggttacgtgcgcgccggcagagccaaaacctgcagccgaaactcccgcttctccggccagcctgcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgctt

SEQ ID NO: 1081 - DNA, 1141 bp, Homo sapiens
  ENST00000335174
gcggccgcggagccccacccgctcctactccagtcctctcacgcccactgacttaccctgcgcacgcgcgctgaggctccgtggggccgccgcgggccccgccccgaggtgggagggcctgacgcatccacagctggccaatcggcggatggcctcgcgcgcccgccccctccccctgcccccggcgccgggctccacgtgccagtgtttgtgtacgtgcggccgtggcggggctggacagggtccgggtcgttgaggattaggctgctcgggcgtaaccggagctggggcgcggctgccaagggccggcccggaagtcccagcggtctttaaattctcccgtgctagggccagcctgcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttggaagcctggagtgcctaagcctgcttgtagccagtgatgcccaaattgatttatgtaataagaacgggcaaacagctgaagatctcgcttggtcatgtggatttccagactgtgccaagtttcttacaacaattaaatgtatgcagacaataaaagcaagtgaacaccctgacaggaatgattgtgttgccgtgctcagacagaaacggagtctcggaagtgtagaaaataccagtgggaaaaggaagtgctgatgtcacgtgggttatgaagaagtctgaagaacgccttcatttcatgcaaatctataagctcctgcttttggctttaccatatgttgtgtctaatctccttctgagaaggacgaaaaactttcttccaagtgaagatccatttaagaacacatgtatttacatgcctataatatgctggttgtgtatgctttgtcttttaagttattaaaggaacgtctaaaaaa

SEQ ID NO: 1082 - DNA, 1444 bp, Homo sapiens
  ENST00000511393
ctttaaattctcccgtgctagggccagcctgcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttggaagcctggagtgcctaagcctgcttgtagccagtgatgcccaaattgatttatgtaataagaacgggcaaacagctgaagatctcgcttggtcatgtggatttccagactgtgccaagtttcttacaacaattaaatgtatgcagacaataaaagcaagtgaacaccctgacaggaatgattgtgttgccgtgctcagacagaaacggagtctcggaagtgtagaaaataccagtgggaaaaggaagtgctggtaagtaactcagagctgctgcttttttcctcccgcagtgatctcttgtttgcatagcatttattattccatttaatactgacactcgtatttctagtagtattgtttcattctcattaacattttagtactggttatacttaccagagtctagagaccaaaaatgggactgcatggtggaagtttggggataaaactctttttaaaaaaaagtttttaatgttaacgtgtttttaaaaacagatgtcacgtgggttatgaagaagtctgaagaacgccttcatttcatgcaaatctataagctcctgcttttggctttaccatatgttgtgtctaatctccttctgagaaggacgaaaaactttcttccaagtgaagatccatttaagaacacatgtatttacatgcctataatatgctggttgtgtatgctttgtcttttaagttattaaaggaacgtctaaaaaatacattctccgtgcagtatttacaacctttgaaaaaggtcataatttaaatcgtcaaactagaaccaggatttaatgtgaaaaattaaactgattctttattcacaaatttataataccactctactgcagtctttgactccaagatattttaaatcatatttggtcgctgaggaagacataagttatagtatgcatccttgttccaaaaatctgggcccttccatccgcaccagccctggatagagaagacgggaaaggaaagccttttacaaagttacaagattatgtcatggaaatcgtgacatcaggctctgtcagcaggaccttggaataagactctaaatggctttatcattcaaggatttgaattcctactagcatagaa

SEQ ID NO: 1083 - DNA, 668 bp, Homo sapiens
  ENST00000511311
gcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggtaactaggtaactgttgctgtgtacagccgtcccctccaacccagacacacacaaacatttctcagacgccaagagttgtttcagctgttaaaaacatgtctatagcagcgatgtccaacagaaatataatgcaagacacagatgtaatttaagagtttttttccagtcttgatgtgaggacatgagaaatttgaagtttttaagtagccacattaataaacgaaacatgaaattttagtatttgacccaatttgtccaaaatgttatcagttcaatatgtaatcaaagcaattgctgattagatattttacactttcttttattctgtcttcacaatctggtgtgacagcgtatctcaaatcagactagccacatttcaaatactctagccttaagtggctgt

SEQ ID NO: 1084 - DNA, 519 bp, Homo sapiens
  ENST00000506424
gcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggagaagctccactacacaaggcagcaaaagttggaagcctggagtgcctaagcctgcttgtagccagtgatgcccaaattgatttatgtaataagaacgggcaaacagctgaagatctcgcttggtcatgtggatttccagactgtgccaagtttcttacaacaattaaatgtatgcagacaataaaagcaagtgaacaccctgacaggaatgattgtgttgccgtgctcagacagaaacggagtctcggaagtgt

SEQ ID NO: 1085 - DNA, 4066 bp, Homo sapiens
  ENST00000393389
gcctctccagccaagtggctggagtcgggaggctggaaagagactccgagaaagtaccagcggaaggcggccgccgctacggcgattcgcagggagtagcagacgaagacggtggccgccgcactagccaccacgtgtggaggataaacggtctacacggccattccggcgccgagtctagggaaagagttagcgacgacggggaaagaaaatgtgaagagagcgaccgccgctccagggtcgctgcaggaagcctaagtgcagacgccggcttctcccgcagtgacttgagaagggtcagtgaaaacctcggccactgccgcagcgtctctagggagagagttaggggagatagtggccacagtcacagctgctcttgggagagagttaggggagacagcaccttctgcagcagcgacgtgaattttagtgaagttggaggccaccaaactaccgactccaggggaacagccagagaagaccgaggcctccgcctcagtggtccttgggagggagtcagtgacattcgggacccgcgaactagtgacttcggggatagagtcagtgacgatcgcagtcgccgcttcagtggctcctgggagggagggagtgtcgaaggcggccacagcgttggtagttcttgggaggaagtaagtggagaccgcggctacgcagccagcgactcctctggtgtgagcggcagtgaagacgccagctaccgcttcagtggcttttgggagagagaaagtgaagacgaaggtttccgctgcagcttctgggagagagcaagagaggaccttgggccccgtcctagtgacgacggagaagagggccgctgccgctgcagtggctcgtgggtgagagcaagtgaagaccgccgcagcatcaggggcctggactcaactcctccccagagtcggaggtgttgcgccatgcccggggtggccaattcaggcccctccacttcctctagggagactgcaaacccctgttccaggaagaaggtgcattttggcagcatacatgatgcagtacgagctggagatgtaaagcagctttcagaaatagtggtacgtggagccagcattaatgaacttgatgttctccataagtttacccctttacattgggcagcacattctggaagtttggagtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagtggatcccagtgtgactgataagagagaatggagacctgtgcattatgcagcttttcatgggcggcttggctgcttgcaacttcttgttaaatggggttgtagcatagaagatgtggactacaatggaaaccttccagaacctccttagatccctgtggagcctctgattccttggcttggcatgctggacttacataatttggcacctacctacctgcatggcctcatctttctatatctttacactactgtccaggatcattttgtttttttctgaaggtcgtctttcagtgttcatttagtgaagtcttttggtatgaactctttcaatttttgtgtatctgaaaatttattttgttctcattctttttactttgtattttgtaagtttttttttttaaagtaaaatttaaattgaagtctcaaaaaacaaaaagcccctctctcggcgctgcctacggaggtggcagccatctcctcctcagcatcatggccaccctcagaccccttgtgaagcccaggatcatcaaaaagagaactaagaagttcttccggcaccagactgactgatatgtcaaaattaagtgtaactggcagaaacccagaggtattgacaacagggttcgtagaaggttcaaggaccaatcttgatgcccaacattggttgtgggagcgacaaaaaaaacaaagcacatgctgcctactgacttctggaagttcctggtccacaacatcaaggagctggaagtgctgctgatgtgcaacagatcttactgtgctgagatgtttcctccaagaactgcaaagccatcgtggaaagagctgcccagctgtccatcggagtcacaccaaccccaacgccaggctgcgcagtgaagaaaatgaatagacagctcatgtgcatgttttgtgtttaaataaaactgtaaaaactgcaaagaaaaaccaaaaaacaacaacaaaaaattattttgtgttaggcttccttcgctttttcagactgctttcaatttccattttcacatatggtattattagtttttttttttagttttagtctttctgatggatgtatctcattgcagtttcaaatttacatttttcctgatgactaaagatgttgaacatcatttcgtacgtttaaaggctatttggtttttttgtgtgtgtgatgtactagttcaaatcttttgcctattggctgttagagtgtgtctttttcttattgaatcataggagttctttatatattctagatacaagccctttgtcagttacgtttattaccaatatcttttcatgcaaatatctttctaatctttctacttcatggcttgctctttcattctttggtattttttgataaatgaggttttaattattttttttttttgaaatagagtcttgctctgtcgcacaggctggagtgcagtggtgcagtctcggcttgctgcaacctctgcctcccggattcaagcgattcttctgcctcagcctcccgagtagctgggattacaggtgtgcaccaccacgcttggctaatttttgtatttttagtagaaacagaattttagcatgttggccacgctggtcttgaactcctgaccttgtgatccacccacctcggcctcccaaagtgctgggattacaggtgtgagccaccgcgcttggccagaggttttaattttaacgtagtccattttaataatctcttcctttgtagttagtcctttctgtactttccctattttgtgatcatgaagacattcctttatgttatctgttagaaattttatttatctttcatatttatattcccaatcctcctagaactgacttttccgtgtgtaatacaaggtaggggtcagttttatttttgtattgtcctttatcaaatatacttgatcatttttgttggtcttgtctggtcattaaaaaatccaattgtttctttaaacatgtatgattattttatttataaccaggtagagtatttataataatatagatgttaagaaagaatgtggccttaggtctagactgcttgtgttcaaatcgctctcataaaattattttttattgataaatgtacatatttttggtgtacatgtgataatttgatacattcatttgtatcaaatttgataatgtataaagatcaaatcaaggtaattggggtagccatcccttaaatatttcttttatactaggaacatttgaattatttttttctagttatttttaaatacacaatagattatggttaactataatcaccctactgatctgtcaaacactagatcttatttcttctactcaattgtatatttatacccattaatcaacttctgttcttgctctctccgtgctacccttctggcctttggtaatcgccaatcaatctactctctatcttcatgagaccagcgtattttagctcccacatatgaatgaaaacatataatatttgtctttctgtgcttgacttattttacttaacataatgacctccaattccatccatcttgtggcactgacagtatttcattcatttttgtgtgaattatatttcgttgtgaatatacattacattttctttatccattcatcactgatgtgcacttaggttgattccatattttggctattgtgaatagtgtgttaataaacatgagagtgcagtta

SEQ ID NO: 1086 - DNA, 954 bp, Homo sapiens
  ENST00000528722
aagtggctggagtcgggaggctggaaagagactccgagaaagtaccagcggaaggcggccgccgctacggcgattcgcagggagtagcagacgaagacggtggccgccgcactagccaccacgtgtggaggataaacggtctacacggccattccggcgccgagtctagggaaagagttagcgacgacggggaaagaaaatgtgaagagagcgaccgccgctccagggtcgctgcaggaagcctaagtgcagacgccggcttctcccgcagtgacttgagaagggttccaggaagaaggtgcattttggcagcatacatgatgcagtacgagctggagatgtaaagcagctttcagaaatagtggtacgtggagccagcattaatgaacttgatgttctccataagtttacccctttacattgggcagcacattctggaagtttggagtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagtggatcccagtgtgactgataagagagaatggagacctgtgcattatgcagcttttcatgggcggcttggctgcttgcaacttcttgttaaatggggttgtagcatagaagatgtggactacaatggaaaccttccagaacctccttagatccctgtggagcctctgattccttggcttggcatgctggacttacataatttggcacctacctacctgcatggcctcatctttctatatctttacactactgtccaggatcattttgtttttttctgaag

SEQ ID NO: 1087 - DNA, 2514 bp, Homo sapiens
  ENST00000260047
tggaggataaacggtctacacggccattccggcgccgagtctagggaaagagttagcgacgacggggaaagaaaatgtgaagagagcgaccgccgctccagggtcgctgcaggaagcctaagtgcagacgccggcttctcccgcagtgacttgagaagggtcagtgaaaacctcggccactgccgcagcgtctctagggagagagttaggggagatagtggccacagtcacagctgctcttgggagagagttaggggagacagcaccttctgcagcagcgacgtgaattttagtgaagttggaggccaccaaactaccgactccaggggaacagccagagaagaccgaggcctccgcctcagtggtccttgggagggagtcagtgacattcgggacccgcgaactagtgacttcggggatagagtcagtgacgatcgcagtcgccgcttcagtggctcctgggagggagggagtgtcgaaggcggccacagcgttggtagttcttgggaggaagtaagtggagaccgcggctacgcagccagcgactcctctggtgtgagcggcagtgaagacgccagctaccgcttcagtggcttttgggagagagaaagtgaagacgaaggtttccgctgcagcttctgggagagagcaagagaggaccttgggccccgtcctagtgacgacggagaagagggccgctgccgctgcagtggctcgtgggtgagagcaagtgaagaccgccgcagcatcaggggcctggactcaactcctccccagagtcggaggtgttgcgccatgcccggggtggccaattcaggcccctccacttcctctagggagactgcaaacccctgttccaggaagaaggtgcattttggcagcatacatgatgcagtacgagctggagatgtaaagcagctttcagaaatagtggtacgtggagccagcattaatgaacttgatgttctccataagtttacccctttacattgggcagcacattctggaagtttggagtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagatcccagtgtgactgataagagagaatggagacctgtgcattatgcagcttttcatgggcggcttggctgcttgcaacttcttgttaaatggggttgtagcatagaagatgtggactacaatggaaaccttccagttcacttagcagccatggaaggccaccttcactgtttcaaattcctagtcagtagaatgagcagtgcgacgcaagttttaaaagctttcaatgataatggagaaaatgtactggatttggcccagaggttcttcaagcagaacattttacagtttatccagggggctgagtatgaaggaaaagacctagaggatcaggaaactttagcatttccaggtcatgtggctgcctttaagggtgatttggggatgcttaagaaattagtggaagatggagtaatcaatattaatgagcgtgctgataatggatcaactcctatgcataaagctgctggacaaggccacatagagtgtttgcagtggttaattaaaatgggagcagacagtaatattaccaacaaagcaggggagagacccagtgatgtggcaaagaggtttgcccatttggcagcagtgaagctgttagaggagctacagaaatatgatatagatgacgaaaatgaaattgatgaaaatgatgtgaaatattttataagacatggtgttgagggaagcactgatgccaaggatgatttatgtctgagtgacttggataaaacagatgccagaatgagagcttacaagaaaattgtagaattgagacacctcctggaaattgccgagagcaactataaacacttgggaggcataacagaagaagatttaaagcagaagaaagaacagcttgagtctgaaaagaccatcaaagaactgcagggccagctggagtatgaacgactacgtagagaaaaattagaatgtcagcttgatgaatatcgagcagaagttgatcaactcagggaaacactggaaaaaattcaagtcccaaactttgtggctatggaagacagcgcttcttgtgagtcaaacaaagagaagaggcgagtaaaaaaaaaggtttcttctggaggggtgtttgtgagaaggtactaatcagtgaaataactaaattgacctgctagatttttctctttcattaaaaaaattgatataaatgtgagtctatacaaactatctcagaattactctgatatgcttctgttccaattctgatggcagaaatgttatattaaagagatttagagattttttaaatga

SEQ ID NO: 1088 - DNA, 3230 bp, Homo sapiens
  ENST00000526731
agggagtcagtgacattcgggacccgcgaactagtgacttcggggatagagtcagtgacgatcgcagtcgccgcttcagtggctcctgggagggagggagtgtcgaaggcggccacagcgttggtagttcttgggaggaagtaagtggagaccgcggctacgcagccagcgactcctctggtgtgagcggcagtgaagacgccagctaccgcttcagtggcttttgggagagagaaagtgaagacgaaggtttccgctgcagcttctgggagagagcaagagaggaccttgggccccgtcctagtgacgacggagaagagggccgctgccgctgcagtggctcgtgggtgagagcaagtgaagaccgccgcagcatcaggggcctggactcaactcctccccagagtcggaggtgttgcgccatgcccggggtggccaattcaggcccctccacttcctctagggagactgcaaacccctgttccaggaagaaggtgcattttggcagcatacatgatgcagtacgagctggagatgtaaagcagctttcagaaatagtggtacgtggagccagcattaatgaacttgatgttctccataagtttacccctttacattgggcagcacattctggaagtttggagtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagtggatcccagtgtgactgataagagagaatggagacctgtgcattatgcagcttttcatgggcggcttggctgcttgcaacttcttgttaaatggggttgtagcatagaagatgtggactacaatggaaaccttccaggtggcagccatctcctcctcagcatcatggccaccctcagaccccttgtgaagcccaggatcatcaaaaagagaactaagaagttcttccggcaccagactgactgatatgtcaaaattaagtgtaactggcagaaacccagaggtattgacaacagggttcgtagaaggttcaaggaccaatcttgatgcccaacattggttgtgggagcgacaaaaaaaacaaagcacatgctgcctactgacttctggaagttcctggtccacaacatcaaggagctggaagtgctgctgatgtgcaacagatcttactgtgctgagatgtttcctccaagaactgcaaagccatcgtggaaagagctgcccagctgtccatcggagtcacaccaaccccaacgccaggctgcgcagtgaagaaaatgaatagacagctcatgtgcatgttttgtgtttaaataaaactgtaaaaactgcaaagaaaaaccaaaaaacaacaacaaaaaattattttgtgttaggcttccttcgctttttcagactgctttcaatttccattttcacatatggtattattagtttttttttttagttttagtctttctgatggatgtatctcattgcagtttcaaatttacatttttcctgatgactaaagatgttgaacatcatttcgtacgtttaaaggctatttggtttttttgtgtgtgtgatgtactagttcaaatcttttgcctattggctgttagagtgtgtctttttcttattgaatcataggagttctttatatattctagatacaagccctttgtcagttacgtttattaccaatatcttttcatgcaaatatctttctaatctttctacttcatggcttgctctttcattctttggtattttttgataaatgaggttttaattattttttttttttgaaatagagtcttgctctgtcgcacaggctggagtgcagtggtgcagtctcggcttgctgcaacctctgcctcccggattcaagcgattcttctgcctcagcctcccgagtagctgggattacaggtgtgcaccaccacgcttggctaatttttgtatttttagtagaaacagaattttagcatgttggccacgctggtcttgaactcctgaccttgtgatccacccacctcggcctcccaaagtgctgggattacaggtgtgagccaccgcgcttggccagaggttttaattttaacgtagtccattttaataatctcttcctttgtagttagtcctttctgtactttccctattttgtgatcatgaagacattcctttatgttatctgttagaaattttatttatctttcatatttatattcccaatcctcctagaactgacttttccgtgtgtaatacaaggtaggggtcagttttatttttgtattgtcctttatcaaatatacttgatcatttttgttggtcttgtctggtcattaaaaaatccaattgtttctttaaacatgtatgattattttatttataaccaggtagagtatttataataatatagatgttaagaaagaatgtggccttaggtctagactgcttgtgttcaaatcgctctcataaaattattttttattgataaatgtacatatttttggtgtacatgtgataatttgatacattcatttgtatcaaatttgataatgtataaagatcaaatcaaggtaattggggtagccatcccttaaatatttcttttatactaggaacatttgaattatttttttctagttatttttaaatacacaatagattatggttaactataatcaccctactgatctgtcaaacactagatcttatttcttctactcaattgtatatttatacccattaatcaacttctgttcttgctctctccgtgctacccttctggcctttggtaatcgccaatcaatctactctctatcttcatgagaccagcgtattttagctcccacatatgaatgaaaacatataatatttgtctttctgtgcttgacttattttacttaacataatgacctccaattccatccatcttgtggcactgacagtatttcattcatttttgtgtgaattatatttcgttgtgaatatacattacattttctttatccattcatcactgatgtgcacttaggttgattccatattttggctattgtgaatagtgtgttaataaacatgagagtgcagtta

SEQ ID NO: 1089 - DNA, 1887 bp, Homo sapiens
  ENST00000531895
gaccgcggctacgcagccagcgactcctctggtgtgagcggcagtgaagacgccagctaccgcttcagtggcttttgggagagagaaagtgaagacgaaggtttccgctgcagcttctgggagagagcaagagaggaccttgggccccgtcctagtgacgacggagaagagggccgctgccgctgcagtggctcgtgggtgagagcaagtgaagaccgccgcagcatcaggggcctggactcaactcctccccagagtcggaggtgttgcgccatgcccggggtggccaattcaggcccctccacttcctctagggagactgcaaacccctgttccaggaagaaggtgcattttggcagcatacatgatgcagtacgagctggagatgtaaagcagctttcagaaatagtggtacgtggagccagcattaatgaacttgatgttctccataagtttacccctttacattgggcagcacattctggaagtttggagtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagtggatcccagtgtgactgataagagagaatggagacctgtgcattatgcagcttttcatgggcggcttggctgcttgcaacttcttgttaaatggggttgtagcatagaagatgtggactacaatggaaaccttccagttcacttagcagccatggaaggccaccttcactgtttcaaattcctagtcagtagaatgagcagtgcgacgcaagttttaaaagctttcaatgataatggagaaaatgtactggatttggcccagaggttcttcaagcagaacattttacagtttatccagggggctgagtatgaaggaaaagacctagaggatcaggaaactttagcatttccaggtcatgtggctgcctttaagggtgatttggggatgcttaagaaattagtggaagatggagtaatcaatattaatgagcgtgctgataatggatcaactcctatgcataaagctgctggacaaggccacatagagtgtttgcagtggttaattaaaatgggagcagacagtaatattaccaacaaagcaggggagagacccagtgatgtggcaaagaggtttgcccatttggcagcagtgaagctgttagaggagctacagaaatatgatatagatgacgaaaatgaaattgatgaaaatgatgtgaaatattttataagacatggtgttgagggaagcactgatgccaaggatgatttatgtctgagtgacttggataaaacagatgccagaatgagagcttacaagaaaattgtagaattgagacacctcctggaaattgccgagagcaactataaacacttgggaggcataacagaagaagatttaaagcagaagaaagaacagcttgagtctgaaaagaccatcaaagaactgcagggccagctggagtatgaacgactacgtagagaaaaattagaatgtcagcttgatgaatatcgagcagaagttgatcaactcagggaaacactggaaaaaattcaagtcccaaactttgtggctatgacagcgcttcttgtgagtcaaacaaagagaagaggcgagtaaaaaaaaaggtttcttctggaggggtgtttgtgagaaggtactaatcagtgaaataactaaattgacctgctagatttttctctttcattaaaaaaattgatataa

SEQ ID NO: 1090 - DNA, 2302 bp, Homo sapiens
  ENST00000393392
agcttctgggagagagcaagagaggaccttgggccccgtcctagtgacgacggagaagagggccgctgccgctgcagtggctcgtgggtgagagcaagtgaagaccgccgcagcatcaggggcctggactcaactcctccccagagtcggaggtgttgcgccatgcccggggtggccaattcaggcccctccacttcctctagggagactgcaaacccctgttccaggaagaaggtgcattttggcagcatacatgatgcagtacgagctggagatgtaaagcagctttcagaaatagtgtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagtggatcccagtgtgactgataagagagaatggagacctgtgcattatgcagcttttcatgggcggcttggctgcttgcaacttcttgttaaatggggttgtagcatagaagatgtggactacaatggaaaccttccagttcacttagcagccatggaaggccaccttcactgtttcaaattcctagtcagtagaatgagcagtgcgacgcaagttttaaaagctttcaatgataatggagaaaatgtactggatttggcccagaggttcttcaagcagaacattttacagtttatccagggggctgagtatgaaggaaaagacctagaggatcaggaaactttagcatttccaggtcatgtggctgcctttaagggtgatttggggatgcttaagaaattagtggaagatggagtaatcaatattaatgagcgtgctgataatggatcaactcctatgcataaagctgctggacaaggccacatagagtgtttgcagtggttaattaaaatgggagcagacagtaatattaccaacaaagcaggggagagacccagtgatgtggcaaagaggtttgcccatttggcagcagtgaagctgttagaggagctacagaaatatgatatagatgacgaaaatgaaattgatgaaaatgatgtgaaatattttataagacatggtgttgagggaagcactgatgccaaggatgatttatgtctgagtgacttggataaaacagatgccagaagaccatcaaagaactgcagggccagctggagtatgaacgactacgtagagaaaaattagaatgtcagcttgatgaatatcgagcagaagttgatcaactcagggaaacactggaaaaaattcaagtcccaaactttgtggctatggttggtgtcctttttaatacatttatttttctcaagaagtatatacaagagtggccaagagtacaagctttgggctggggctctttggacttgaatcctggctatagtcttttttgatttgggctactcatttaacctttttgtgcctcaactataaactggagatgataacttatactttctagagctgatgacaggattaaaggaatacacacacacacacacacacacacacacacacacacacactctatatgtaactataactttctagatacatacacacatctgtctatctatcttcaaacagcagcctagttcataagtattattgttaacattgtaccatagaaggagaaaatgttttcataagtaatcaatcagaattctaagacagctagaggatatgtatattttaatattctaaataaccaaaataaagtgctttgaatggaatccatattttctttccatagggaagtttcttcatcaatcatcatggatgaattaattctgtttgaggcttgtgtcacctcaaatctgatctattaatattatagaatcttcctggcttctttttattttgcacaaactagtcattggtctctttaataaccactttaaaaatattaaaataataaaacatgtttgttgtatagtgttaaaaacaagatagatgttccttctgacactaagttccactctccagaggaagctattgttaacaatttagtacataccatattagacaaaattctatttatctgcaaacatgtatgtgtatttctatgcatatgcaaatataaccacttcctcagtttctctgggttttggtgtctcaccagtggttgattttccaagaaatataattaactataataatt

SEQ ID NO: 1091 - DNA, 1949 bp, Homo sapiens
  ENST00000533342
ctccccagagtcggaggtgttgcgccatgcccggggtggccaattcaggcccctccacttcctctagggagactgcaaacccctgttccaggaagaaggtgcattttggcagcatacatgatgcagtacgagctggagatgtaaagcagctttcagaaatagtggtacgtggagccagcattaatgaacttgatgttctccataagtttacccctttacattgggcagcacattctggaagtttggagtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagtggatcccagtgtgactgataagagagaatggagacctgtgcattatgcagcttttcatgggcggcttggctgcttgcaacttcttgttaaatggggttgtagcatagaagatgtggactacaatggaaaccttccagttcacttagcagccatggaaggccaccttcactgtttcaaattcctagtcagtagaatgagcagtgcgacgcaagttttaaaagctttcaatgataatggagaaaatgtactggatttggcccagaggttcttcaagcagaacattttacagtttatccagggggctgagtatgaaggaaaagacctagaggatcaggaaactttagcatttccaggtcatgtggctgcctttaagggtgatttggggatgcttaagaaattagtggaagatggagtaatcaatattaatgagcgtgctgataatggatcaactcctatgcataaagctgctggacaaggccacatagagtgtttgcagtggttaattaaaatgggagcagacagtaatattaccaacaaagcaggggagagacccagtgatgtggcaaagaggtttgcccatttggcagcagtgaagctgttagaggagctacagaaatatgatatagatgacgaaaatgaaattgatgaaaatgatgtgaaatattttataagacatggtgttgagggaagcactgatgccaaggatgatttatgtctgagtgacttggataaaacagatgccagaatgagagcttacaagaaaattgtagaattgagacacctcctggaaattgccgagagcaactataaacacttgggaggcataacagaagaagatttaaagcagaagaaagaacagcttgagtctgaaaagaccatcaaagaactgcagggccagctggagtatgaacgactacgtagagaaaaattagaatgtcagcttgatgaatatcgagcagaagttgatcaactcagggaaacactggaaaaaattcaagtcccaaactttgtggctatggttggtgtcctttttaatacatttatttttctcaagaagtatatacaagagtggccaagagtacaagctttgggctggggctctttggacttgaatcctggctatagtcttttttgatttgggctactcatttaacctttttgtgcctcaactataaactggagatgataacttatactttctagagctgatgacaggattaaaggaatacacacacacacacacacacacacacacacacacacacactctatatgtaactataactttctagatacatacacacatctgtctatctatcttcaaacagcagcctagttcataagtattattgttaacattgtaccatagaaggagaaaatgttttcataagtaatcaatcagaattctaagacagctagaggatatgtatattttaatattctaaataaccaaaataaagtgctttgaatggaa

SEQ ID NO: 1092 - DNA, 594 bp, Homo sapiens
  ENST00000531815
gatttggggatgcttaagaaattagtggaagatggagtaatcaatattaatgagcgtgctgataatggatcaactcctatgcataaagctgctggacaaggccacatagagtgtttgcagtggttaattaaaatgggagcagacagtaatattaccaacaaagcaggggagagacccagtgatgtggcaaagaggaccatcaaagaactgcagggccagctggagtatgaacgactacgtagagaaaaattagaatgtcagcttgatgaatatcgagcagaagttgatcaactcagggaaacactggaaaaaattcaagtcccaaactttgtggctatggaagacagcgcttcttgtgagtcaaacaaagagaagaggcgagtaaaaaaaaaggtttcttctggaggggtgtttgtgagaaggtactaatcagtgaaataactaaattgacctgctagatttttctctttcattaaaaaaattgatataaatgtgagtctatacaaactatctcagaattactctgatatgcttctgttccaattctgatggcagaaatgttatattaaagagatttagagattttttaaatga

SEQ ID NO: 1093 - DNA, 855 bp, Homo sapiens
  ENST00000528190
aactgcagggccagctggagtatgaacgactacgtagagaaaaattagaatgtcagcttgatgaatatcgagcagaagttgatcaactcagggaaacactggaaaaaattcaagtcccaaactttgtggctatggaagacagcgcttcttgtgagtcaaacaaagagaagaggcgagtaaaaaaaaaggtttcttctggaggggtgtttgtgagaagatttacaattgggcaagtcactttacctagggcagagtggataaggggatgaagagtgacgacagtgttatgctactggagcttccttcacatggaggaaagacgcattccctcttaatattttagaatattttaaatcttaacaaaccaataatttacttgtttatgtctctctccttaagattgtcaattcaatgagaatgaaaccatgttcatctctgtgcacacagggactagcatgctgtttggcatatagcaggcagtcatattggttaactgaacaaatgcagtatactttgttacagtggactttaatatatatggtaacttattaattgactcagtgaaaattaatctataatatactaagaactctcttaggcaatagagataaaaatgaatcagaatgtaacaggataatgtcaaggtttttcttttgaaaacaaaccagcagttagatttttgaggaaaatatagttggaaagcctgactctcactcactggaccatatggaccaatctcttgactgctctatactgcagattccctgtttatagctaaacaaatgacaaggctattttgaataatgattgtcaaacttttatagctattaccaaggcattatgaactcaaaatgt

SEQ ID NO: 1094 - DNA, 4787 bp, Homo sapiens
  ENST00000265748
agcgcgcatgctcgcggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccagacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaa

SEQ ID NO: 1095 - DNA, 4661 bp, Homo sapiens
  ENST00000396068
ggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccagacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaagaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaa

SEQ ID NO: 1096 - DNA, 596 bp, Homo sapiens
  ENST00000424865
gtgcgggccggggtcgccgcggctgcggcctgctgtggttgaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccagacctctgctttcaaatgcc

SEQ ID NO: 1097 - DNA, 463 bp, Homo sapiens
  ENST00000418118
gtttcggtcctacagataaaactcagggaggaaggctttgagtctgtcctaaaaggctgttgcgagaggtctttcagcccccgtttttaccatgtccctctgcagtcctggcgcagcaagagtgaggcgcaggcctgcggaacgggtcctgctggaagcagctggaatgccctgcagggcggggtccggggccggtgactcagtgcggctgccgccgggaaaggcagtaggatgtgtgatttgcggagttcacgcagcccgcaggggagatgctaatgaaatgacagcaaaacgttaaaataagcagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaaggt

SEQ ID NO: 1098 - DNA, 569 bp, Homo sapiens
  ENST00000460598
aaagcctgcaaagtgtgtactggcatctagtgacaatggcaaaaccaacttcagggcagtggtataggcagaagatgacattcctgaaagctcactcttctcaccaatgccatcagaggaaaaggctgcttcccctcccagacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgg

SEQ ID NO: 1099 - DNA, 557 bp, Homo sapiens
  ENST00000429082
aaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgtgttttcatgtttcagaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacat

SEQ ID NO: 1100 - DNA, 716 bp, Homo sapiens
  ENST00000441696
aattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtggtaaaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccct

SEQ ID NO: 1101 - DNA, 580 bp, Homo sapiens
  ENST00000452877
gtctttggttaatgcctcaatttccagctctgtggtaaaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaaactcactgtcagagcactcccctcaaaaaacaccaaggtgtttcaaaaactcagtcacttccagtaacagaaaaggtgaccgaaaaccagataccagccaaaaattctagtacagaacctaaagg

SEQ ID NO: 1102 - DNA, 607 bp, Homo sapiens
  ENST00000495714
aatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggtttcactgaatgcgaaatgacgaaatctagccctttgaaaataacattgtttttagaagaggacaaat

SEQ ID NO: 1103 - DNA, 707 bp, Homo sapiens
  ENST00000428612
tcaagaacatagcaaagaaagtccagctcgtagcacaccccacagaacccccattattactccaaatacaaaggccatccaagaaagattattcaagcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactc

SEQ ID NO: 1104 - DNA, 829 bp, Homo sapiens
  ENST00000446635
gtccaaaaccaggaaaattccaaagaactcgtgtccctcgagctgaatctggtgatagccttggttctgaagatcgtgatcttctttacagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttc

SEQ ID NO: 1105 - DNA, 757 bp, Homo sapiens
  ENST00000457743
ttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaagataaattatgatgtaagagagcgagagctactgggctatttgttccaggaaaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaag

SEQ ID NO: 1106 - DNA, 2078 bp, Homo sapiens
  ENST00000491782
ctttcaccagtgatgcataagaaactgtattactcactccctaaccaatcaacagaggttgttactgttttttccagacttagccaatctaaggttttaaattggtatgttctatttttatttttaaaaattctaatagagttgacacacttattggctgttggctcatgtgtgcctatatgtgtttcttttcccattttcaggaccatttggtctcgtgaatgttttcctccactttgactcgtatcataggaattcatggctgccaacaatccagggcagttgtctgcccttatctttcatagatatataaagaaatatttacacatgaaatccaatgtctaggtttccttttatagaaaggggagaagtgggtaagttgtagataaaaggcacttgagtgtgtttctcattgttatagctggttttggtacctggggctcattatactgttgtttgtattttttatttgaagttcaccataataaagagctttataggatagttggcaagagctaccagttgatatttttgggttttatttttatgtctagctaggaacaataataaatgttaaatatgtttctctaagcccagtgtaactaaattttaacttttaaataatagctttttaatatttaatttgtaccaacttaaatgctgcttaatgcttactgacttaaatagtcttattttctactaatttctcttaatttgtttttaaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctc

SEQ ID NO: 1107 - DNA, 961 bp, Homo sapiens
  ENST00000573650
tctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaatt

SEQ ID NO: 1108 - DNA, 1301 bp, Homo sapiens
  ENST00000575847
tctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaattccatgtcaccaacaacacagacaagaccctgtttacaactttttctttccttttttttaattttagacctttctgagaagattattatatatgacatatctatagctatgtgtatggccatagatgtatttctgtgtgtacatatgtatagtcatgtattcctgcatatgtacatacaaatacagagatatataaagtacatagaaattccttacttgtaaatagccaaaaagtactgacatgagtgaattttcacatttaaatagtcatcaatatgaagccatgattaatgcttgtataatgtgatgcaataaaatttaaaataaatttctgcacatgg

SEQ ID NO: 1109 - DNA, 1315 bp, Homo sapiens
  ENST00000570509
tctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaattccatgtcaccaacaacacagacaagaccctgtttacaactttttctttccttttttttaattttagacctttctgagaagattattatatatgacatatctatagctatgtgtatggccatagatgtatttctgtgtgtacatatgtatagtcatgtattcctgcatatgtacatacaaatacagagatatataaagtacatagaaattccttacttgtaaatagccaaaaagtactgacatgagtgaattttcacatttaaatagtcatcaatatgaagccatgattaatgcttgtataatgtgatgcaataaaatttaaaataaatttctgcacatggaatattttcagctg

SEQ ID NO: 1110 - DNA, 1385 bp, Homo sapiens
  ENST00000549155
atggcctccctcaccgcatacgacaaagatgtgagcagcggaagttataacctttcctctgcaacgacgggcagctactacagttgtgtcagccagatcaccataggttatgacgttgcggggcctgtggcaattgggcttacccactggaaaaatccatacgtacaaggcagaccaaccctcccatcagatctgcctctcttcgtctccaaagatgcaggcatccctgtgtaccaccgatccttcacccgcaagactgaccaggccacacctttgtcctgtccagcctcactgtctatcactccagtgccttcttacagcagtagcagccaggaaaccctgagtcaagacacaacaggtttaagtttatctattcatggggctgaaaagcgtttgcaaatccatcaacggcgaagtgtggcaagccgcccagcgtcacgtcgtcgcctgcctgtggtcaggcattcctcactcccaccaggcagaaggtcaataaaaatggaggcaagctcttctggaatcactaatggaaaaaccaaagtcttccacccagaaggaggtgtggatttgcaaggctaccagctggatatgcaaatactacctgacgggccaaagagtgatgtggacttttcagagattcttaatgcaatacaagaaatggccaaggatgtcaatattctttttgatgaattagaagctgtcagcagtccttgcaaagatgacgattctcttcttcaccctggaaacctgactagtacttcagatgatgccagcagattggaagccgggggagagacagtgccagaaagaaacaaatcaaatggactttactttcgagatggaaagtgtcgaattgactacatccttgtgtacagaaaatccaacccccagactgaaaagagagaagtatttgaaagaaacattagagcagaaggattgcaaatggagaaagagtcctctctaataaatagtgacattatctttgtgaagttgcatgccccatgggaagtccttggaagatatgcagaacaaatgaatgtaagaatgcctttcagttcaaactgtaactgacgatgggttttcttctcgactggcttcatttttgctgttcttccaggagaaaaatctattacctgccccgccgttacaagttcatgagcaggatcgataaacaaataagcaggtttcggagatggttacctaagaagccaatgaggctggacaaggagacactgccagacctggaggagaatgactgctacactgcccctttcagccagcaaaggatccatcacttcatcatacacaacaaagaaacgttcttcaacaatgccacaagaagtagaatcgtgcatcacattttacaaagaataaaatatgaagaa

SEQ ID NO: 1111 - DNA, 554 bp, Homo sapiens
  ENST00000551148
actgatgttctctccggcagttccttccactctaaagagactccttttcatccctcttctcgcctttcctagcccagcctagtgcccaccctcccccgaccatgcctcccctgcacctggggagggggaggaccagtcctgggcgtgatgctctgagacggtggtgaaatccaccaggctgctttcactccggctcgctctccggagagtcctgttccagacttctcagggtttttacagcacaaacaactgcatacggcccgaggggaggctgaaaaggacttgtgtgtggtggttttattgcctgtcatcactttgctggcctcctcccgactggagcctggaggttcacagtggatttctttctgccgaagacaccaaggcactgaggaaggatcccttctccttctgttgactctttctatttttatggaaacctggaggaagacaattcaggactagttcagcagctcaaggaaggcctccaggatacaggcttcttctactgtcctaaacatgtttaagtttatctattcatggggctgaaaagcgtt

SEQ ID NO: 1112 - DNA, 571 bp, Homo sapiens
  ENST00000546991
tttcactccggctcgctctccggagagtcctgttccagacttctcagggtttttacagcacaaacaactgcatacggcccgaggggaggctgaaaaggacttgtgtgtggtggttttattgcctgtcatcactttgctggcctcctcccgactggagcctggaggttcacagtggatttctttctgccgaagacaccaaggcactgaggaaggatcccttctccttctgttgactctttctatttttatggctccagctcattcctggctttagttgaacttttctgacattcttcatatagcatgcagtccagtggaccttcttctgctgagagcagtattgctggccaggctgtctgggttcaaagctaggctgtgcctcataaacatgacctttggtttaagtttatctattcatggggctgaaaagcgtttgcaaatccatcaacggcgaagtgtggcaagccgcccagcgtcacgtcgtcgcctgcctgtggtcaggcattcctcactcccaccaggcagaaggtcaataaaaatggaggcaagctcttctggaatcactaatgga

SEQ ID NO: 1113 - DNA, 3909 bp, Homo sapiens
  ENST00000392979
ctgttccagacttctcagggtttttacagcacaaacaactgcatacggcccgaggggaggctgaaaaggacttgtgtgtggtggttttattgcctgtcatcactttgctggcctcctcccgactggagcctggaggttcacagtggatttctttctgccgaagacaccaaggcactgaggaaggatcccttctccttctgttgactctttctatttttatggtttaagtttatctattcatggggctgaaaagcgtttgcaaatccatcaacggcgaagtgtggcaagccgcccagcgtcacgtcgtcgcctgcctgtggtcaggcattcctcactcccaccaggcagaaggtcaataaaaatggaggcaagctcttctggaatcactaatggaaaaaccaaagtcttccacccagtggccaaggatgtcaatattctttttgatgaattagaagctgtcagcagtccttgcaaagatgacgattctcttcttcaccctggaaacctgactagtacttcagatgatgccagcagattggaagccgggggagagacagtgccagaaagaaacaaatcaaatggactttactttcgagatggaaagtgtcgaattgactacatccttgtgtacagaaaatccaacccccagactgaaaagagagaagtatttgaaagaaacattagagcagaaggattgcaaatggagaaagagtcctctctaataaatagtgacattatctttgtgaagttgcatgccccatgggaagtccttggaagatatgcagaacaaatgaatgtaagaatgcctttcaggagaaaaatctattacctgccccgccgttacaagttcatgagcaggatcgataaacaaataagcaggtttcggagatggttacctaagaagccaatgaggctggacaaggagacactgccagacctggaggagaatgactgctacactgcccctttcagccagcaaaggatccatcacttcatcatacacaacaaagaaacgttcttcaacaatgccacaagaagtagaatcgtgcatcacattttacaaagaataaaatatgaagaaggaaaaaacaagattggtctgaatcgtttgcttaccaatggctcctatgaagctgcgtttcccctgcatgagggaagttatagaagtaaaaactccattcgaacccatggagcagaaaaccaccgacatctactctatgagtgctgggcctcctggggcgtgtggtataaataccaacctttggatcttgtaaggcggtactttggagagaagattgggttatattttgcctggttgggctggtacaccggcatgctcttcccagctgccttcattggattgtttgtctttttgtatggcgtcaccactctggatcacagccaagtcagtaaagaagtctgccaagctacagatatcatcatgtgtcctgtgtgtgataaatactgtccattcatgaggctgtcagacagctgtgtatatgccaaggtaacccacctttttgacaatggagccactgtcttctttgctgttttcatggcagtctgggcaacagttttcctggagttttggaaaagacggcgagcagtaattgcttatgactgggatttgatagactgggaagaagaggaggaagaaatacgaccccagtttgaagccaagtattccaagaaagagcggatgaatccaatttctggaaagccagaaccttatcaagcatttacagataaatgcagcagacttatcgtttctgcatctggaatattttttatgatctgcgtggtgattgctgccgtgttcgggatcgtcatttaccgggtggtgactgtcagcactttcgctgcctttaagtgggcgttaatcaggaataactctcaggttgcaaccacagggactgctgtgtgcatcaacttctgtatcattatgttgctgaatgtgctctatgaaaaagttgccctgcttctgacgaatttagaacagcctcgcacagagtctgagtgggagaacagcttcaccctgaaaatgtttctttttcagtttgtcaatctgaacagctccacattttacatcgcattcttcctcggaagatttacaggacacccaggtgcctacttgaggctgataaacaggtggagactagaagagtgccaccctagtggatgccttattgatctgtgtatgcaaatgggtattataatggtgctaaagcagacctggaataatttcatggaacttggctacccgttaattcagaattggtggactagaagaaaagtacgacaagaacatggacctgaaaggaaaataagtttcccacaatgggaaaaggactataaccttcagccgatgaatgcctatggactcttcgatgaatacttagaaatgattcttcagtttggattcacaactatctttgtggcagcttttcccctagcaccacttctggccttactgaataacataattgaaattcgacttgatgcttacaaatttgtcacacagtggaggagacctttagcttcaagggccaaagacataggaatttggtatggaattcttgaaggcattggaattctctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaattccatgtcaccaacaacacagacaagaccctgtttacaactttttctttccttttttttaattttagacctttctgagaagattattatatatgacatatctatagctatgtgtatggccatagatgtatttctgtgtgtacatatgtatagtcatgtattcctgcatatgtacatacaaatacagagatatataaagtacatagaaattccttacttgtaaatagccaaaaagtactgacatgagtgaattttcacatttaaatagtcatcaatatgaagccatgattaatgcttgtataatgtgatgcaataaaatttaaaataaatttctgcacatggaatattttcagctg

SEQ ID NO: 1114 - DNA, 3509 bp, Homo sapiens
  ENST00000392977
tttctgccgaagacaccaaggcactgaggaaggatcccttctccttctgttgactctttctatttttatggtttaagtttatctattcatggggctgaaaagcgtttgcaaatccatcaacggcgaagtgtggcaagccgcccagcgtcacgtcgtcgcctgcctgtggtcaggcattcctcactcccaccaggcagaaggtcaataaaaatggaggcaagctcttctggaatcactaatggaaaaaccaaagtcttccacccagaaggaggtgtggatttgcaaggctaccagctggatatgcaaatactacctgacgggccaaagagtgatgtggacttttcagagattcttaatgcaatacaagaaatggccaaggatgtcaatattctttttgatgaattagaagctgtcagcagtccttgcaaagatgacgattctcttcttcaccctggaaacctgactagtacttcagatgatgccagcagattggaagccgggggagagacagtgccagaaagaaacaaatcaaatggactttactttcgagatggaaagtgtcgaattgactacatccttgtgtacagaaaatccaacccccagactgaaaagagagaagtatttgaaagaaacattagagcagaaggattgcaaatggagaaagagtcctctctaataaatagtgacattatctttgtgaagttgcatgccccatgggaagtccttggaagatatgcagaacaaatgaatgtaagaatgcctttcaggagaaaaatctattacctgccccgccgttacaagttcatgagcaggatcgataaacaaataagcaggtttcggagatggttacctaagaagccaatgaggctggacaaggagacactgccagacctggaggagaatgactgctacactgcccctttcagccagcaaaggatccatcacttcatcatacacaacaaagaaacgttcttcaacaatgccacaagaagtagaatcgtgcatcacattttacaaagaataaaatatgaagaaggaaaaaacaagattggtctgaatcgtttgcttaccaatggctcctatgaagctgcgtttcccctgcatgagggaagttatagaagtaaaaactccattcgaacccatggagcagaaaaccaccgacatctactctatgagtgctgggcctcctggggcgtgtggtataaataccaacctttggatcttgtaaggcggtactttggagagaagattgggttatattttgcctggttgggctggtacaccggcatgctcttcccagctgccttcattggattgtttgtctttttgtatggcgtcaccactctggatcacagccaagtcagtaaagaagtctgccaagctacagatatcatcatgtgtcctgtgtgtgataaatactgtccattcatgaggctgtcagacagctgtgtatatgccaaggtaacccacctttttgacaatggagccactgtcttctttgctgttttcatggcagtctgggcaacagttttcctggagttttggaaaagacggcgagcagtaattgcttatgactgggatttgatagactgggaagaagaggaggaagaaatacgaccccagtttgaagccaagtattccaagaaagagcggatgaatccaatttctggaaagccagaaccttatcaagcatttacagataaatgcagcagacttatcgtttctgcatctggaatattttttatgatctgcgtggtgattgctgccgtgttcgggatcgtcatttaccgggtggtgactgtcagcactttcgctgcctttaagtgggcgttaatcaggaataactctcaggttgcaaccacagggactgctgtgtgcatcaacttctgtatcattatgttgctgaatgtgctctatgaaaaagttgccctgcttctgacgaatttagaacagcctcgcacagagtctgagtgggagaacagcttcaccctgaaaatgtttctttttcagtttgtcaatctgaacagctccacattttacatcgcattcttcctcggaagatttacaggacacccaggtgcctacttgaggctgataaacaggtggagactagaagagtgccaccctagtggatgccttattgatctgtgtatgcaaatgggtattataatggtgctaaagcagacctggaataatttcatggaacttggctacccgttaattcagaattggtggactagaagaaaagtacgacaagaacatggacctgaaaggaaaataagtttcccacaatgggaaaaggactataaccttcagccgatgaatgcctatggactcttcgatgaatacttagaaatgattcttcagtttggattcacaactatctttgtggcagcttttcccctagcaccacttctggccttactgaataacataattgaaattcgacttgatgcttacaaatttgtcacacagtggaggagacctttagcttcaagggccaaagacataggaatttggtatggaattcttgaaggcattggaattctctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaatt

SEQ ID NO: 1115 - DNA, 537 bp, Homo sapiens
  ENST00000549234
ttacagctagagctcttctctgacctcagatgttttccaaacacaaaatgaattttttagaacctacagaatgatcgataaacaaataagcaggtttcggagatggttacctaagaagccaatgaggctggacaaggagacactgccagacctggaggagaatgactgctacactgcccctttcagccagcaaaggatccatcacttcatcatacacaacaaagaaacgttcttcaacaatgccacaagaagtagaatcgtgcatcacattttacaaagaataaaatatgaagaaggaaaaaacaagattggtctgaatcgtttgcttaccaatggctcctatgaagctgcgtttcccctgcatgagggaagttatagaagtaaaaactccattcgaacccatggagcagaaaaccaccgacatctactctatgagtgctgggcctcctggggcgtgtggtataaataccaacctttggatcttgtaaggcggtactttggagagaagattgggttatattttgcctggttgggctg

SEQ ID NO: 1116 - DNA, 401 bp, Homo sapiens
  ENST00000548940
tggtacaccggcatgctcttcccagctgccttcattggattgtttgtctttttgtatggcgtcaccactctggatcacagccaagtcagtaaagaagtctgccaagctacagatatcatcatgtgtcctgtgtgtgataaatactgtccattcatgaggctgtcagacagctgtgtatatgccaaggtaacccacctttttgacaatggagccactgtcttctttgctgttttcatggcagtctgggatctgcgtggtgattgctgccgtgttcgggatcgtcatttaccgggtggtgactgtcagcactttcgctgcctttaagtgggcgttaatcaggaataactctcaggttgcaaccacagggactgctgtgtgcatcaacttctgtatcattatgt

SEQ ID NO: 1117 - DNA, 2293 bp, Homo sapiens
  ENST00000550015
aacaataccttcctggtcctaaatataactatatccatacacatatgtaacccacctttttgacaatggagccactgtcttctttgctgttttcatggcagtctgggcaacagttttcctggagttttggaaaagacggcgagcagtaattgcttatgactgggatttgatagactgggaagaagaggagatctgcgtggtgattgctgccgtgttcgggatcgtcatttaccgggtggtgactgtcagcactttcgctgcctttaagtgggcgttaatcaggaataactctcaggttgcaaccacagggactgctgtgtgcatcaacttctgtatcattatgttgctgaatgtgctctatgaaaaagttgccctgcttctgacgaatttagaacagcctcgcacagagtctgagtgggagaacagcttcaccctgaaaatgtttctttttcagtttgtcaatctgaacagctccacattttacatcgcattcttcctcggaagatttacaggacacccaggtgcctacttgaggctgataaacaggtggagactagaagagtgccaccctagtggatgccttattgatctgtgtatgcaaatgggtattataatggtgctaaagcagacctggaataatttcatggaacttggctacccgttaattcagaattggtggactagaagaaaagtacgacaagaacatggacctgaaaggaaaataagtttcccacaatgggaaaaggactataaccttcagccgatgaatgcctatggactcttcgatgaatacttagaaatgattcttcagtttggattcacaactatctttgtggcagcttttcccctagcaccacttctggccttactgaataacataattgaaattcgacttgatgcttacaaatttgtcacacagtggaggagacctttagcttcaagggccaaagacataggaatttggtatggaattcttgaaggcattggaattctctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaattccatgtcaccaacaacacagacaagaccctgtttacaactttttctttccttttttttaattttagacctttctgagaagattattatatatgacatatctatagctatgtgtatggccatagatgtatttctgtgtgtacatatgtatagtcatgtattcctgcatatgtacatacaaatacagagatatataaagtacatagaaattccttacttgtaaatagccaaaaagtactgacatgagtgaattttcacatttaaatagtcatcaatatgaagccatgattaatgcttgtataatgtgatgcaataaaatttaaaataaatttctgcacatgg

SEQ ID NO: 1118 - DNA, 2780 bp, Homo sapiens
  ENST00000426898
actactccctctgcagtctcgcctgccgacttccttctgcgcgcctcgtaaaaccggggaagttcaatcattccgcagcgagccgcggcggccgcactgggcatgctcagtctccgggctccgctcggcaggcgagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcggaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggatccatagaaagcaacttctcattccttcaagtttgatcatgagactacagcagttcagtcacatcttcagactccatttctagttcttcttgctctttctaccacatctgcagtgacttcctccactgaagtcttgaacttctcaaagtcatccatgaggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttc

SEQ ID NO: 1119 - DNA, 3558 bp, Homo sapiens
  ENST00000425752
cttctgcgcgcctcgtaaaaccggggaagttcaatcattccgcagcgagccgcggcggccgcactgggcatgctcagtctccgggctccgctcggcaggcgagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcgtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagtatctcgctttgttgcccaggctgggacacagtggcatgatcttggctcactgcaacctccgcctcccagttgactgctgtatgtgttataggtttgtcgatgaaattagacttttggaacaactaacttctgactttattgactccctctattatatattttctatttcaataatatctattttcttttctgttactttctttttccttctactttctttggggccaactccgtgtttttctgtatcgaatttcttaagttagatttattcaataattcattcaacaaatatttgtgtgtctattatgtggccagcattgtttcatgtgctcaagatagagtagcattgtttggctcattaatattccaatactggcatttaagaccattaattttcctctaaatcgtatttgagctgcaacccacaagcttttatatgtatagttttttgttgttgctattattaaaagtattttagatcctcccttgttttgcttttcaatctgaaatgccttcatgccattttaatttttaaaaggtaatttaattgagcctaatttctttttcttttttcttttttttgagacagagtcttactctgtcacccaggctggagtgcagtggcgtgatctcagctcaatgcaagctctgcctcccaggttcacgccattctcctgtctcagcctcccaagtagctgggactacaggcgcccaccaccatgcctggct

SEQ ID NO: 1120 - DNA, 5504 bp, Homo sapiens
  ENST00000423947
gggcatgctcagtctccgggctccgctcggcaggcgagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcggtgatgttcctgcctccaggaggccttttctgactcctcatactcacctcccatccagcctggtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagcacgtcatctactctgtgaaatttttcatttcatatgcaattcccgatgtatcaaaacgcacaaagagcaagatccagagagaaaaatacctaacccaaaagcttcttcatgagaatcacctcaaagatatgacgaaaaatatgggggtgatagctgagcggatgatagaagcagtagataacaatttacggccaaaatcagaataagagctttatgttctgagaagcactttaaggaatttagctttgtcaaaatatattaggaatcactaatgagaatgtgtaagttaaatcactttggcaaatatgagtctcaactattgccatttcctcatgtattatttttcagtttcagctagcgatgcagaaactggaaaatgtaaaacttagatcatgaagggcataaaacttatcacccggaaaacctcaatgttacctttttctgataaattggaattttacagaaaaagtccctcagtgtgcttaaaaaccaccccttctaaagtagaatggattcttttttttctgtttgattattttcatttctgtctattctcaggcgcatgatctcctttatttttaagccatgtttcatttcttcacttggctagatctgttccagggtcatcttttccttacagtaccatcattatagatttaatttaatagctttcatgtgattaaaaatagctaactagactcaaggattcacaatatttaggtgtattttcaatacctccagaaaggaaacctcagttaatcagaggaaatagtttcagtcttcatttgagcatgtctttccatctcaaaaaaatactcttagtaggttggagtgaagatagcaaggttttgaagcatatttgtcctaatccacagtgacactttttatcttccaggagcactcctaggaggttccgtgcctaatcaatgttgactgctttgcagatctcaagggaataaaatgacaaaagcagggaaagttacagattcaaacagcattttaactcatgttgatctggataattaatcttttctaaagatgtgtagtttcttggaaaacagtgatatcacatgattaaaattacatttttatcaacataattgtctggaaaagataagcccctcaattttctaccagttgacttttattcattagatacagaaggtgcagtattacacatcaccagctgcctttgtgaatggctcactacacagccattggggtacaactgtgtgcatgggcagaaacagcaagtgccctcattgtggtcattgggtggggagtgccttttgtcaaggagtctgcaggaattggcttatttctgtatgccaaagtgatcaacacaccaaagtctctgccataaagaatgtggcttccttgcatcctccatcctgttactctgggcccagtaatttgatgtaactgtctgattgtactagagacaggagtatacccagcttattcataatcaagtaaagagactcagattagatttgattttttagcctcctctagagccaatcaggcagttaagagtaataaaggaaaagggtttggtcacaaaccctaccattatctggagattacttcctgctgcactcctgtcttgccatgcacgtcttgccccctcacttttgctcagcctagcagtctacttcactttattgccttgtaagtgtcaggcctcctgggcgctctggaaaagacagggagccaggccctctcacccctactggtaacaggtcattgctgggtgcacaagagggaggtgatttgcatcatggtcatgctgcatgggcttcactgggatgctgttaaacaccagaggagccaacctatcagaatcccagcagcaaaggaaaactcagattttagaggctttttacaataaagtagcgtaactctaggtcatgattgatttcaaatgcctgccatgaatgatttgtaagtaattatgtaggatccatcaaagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggaggggaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggca

SEQ ID NO: 1121 - DNA, 835 bp, Homo sapiens
  ENST00000550630
gagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcgggctgaagtgcagtagtggagtagcgcaatcatggctcactgtagcattgactcccagactcaattgatcctcttacctcaacctcctgcgtatctgggaccacaggtgatgttcctgcctccaggaggccttttctgactcctcatactcacctcccatccagcctggtgttggaaaaccttggacagacaattgtccccgatttgggatcactggaaagtcagcatgattttcgaaccccggagtttgtgaaagctattctgaaggttgccctaggaagttgaacataagatggactccagggaattagaaaccctgtttttccatgcaaccctgctctcagacctctgtggacaagtcgcttttccttttagaacctcagtttcctcatatgtaaaaagcagaaagatcagcagtagatatcctcactggagtgttgttcagtgactgcacggtgactgagaaacattttagctatcttaaaatgatgttcataataatatagtgaatagtcttatctaacatttatggatgcttgtggttggctaagcacattacaggg

SEQ ID NO: 1122 - DNA, 5975 bp, Homo sapiens
  ENST00000320560
gagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcgtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagcacgtcatctactctgtgaaatttttcatttcatatgcaattcccgatgtatcaaaacgcacaaagagcaagatccagagagaaaaatacctaacccaaaagcttcttcatgagaatcacctcaaagatatgacgaaaaatatgggggtgatagctgagcggatgatagaagcagtagataacaatttacggccaaaatcagaataagagctttatgttctgagaagcactttaaggaatttagctttgtcaaaatatattaggaatcactaatgagaatgtgtaagttaaatcactttggcaaatatgagtctcaactattgccatttcctcatgtattatttttcagtttcagctagcgatgcagaaactggaaaatgtaaaacttagatcatgaagggcataaaacttatcacccggaaaacctcaatgttacctttttctgataaattggaattttacagaaaaagtccctcagtgtgcttaaaaaccaccccttctaaagtagaatggattcttttttttctgtttgattattttcatttctgtctattctcaggcgcatgatctcctttatttttaagccatgtttcatttcttcacttggctagatctgttccagggtcatcttttccttacagtaccatcattatagatttaatttaatagctttcatgtgattaaaaatagctaactagactcaaggattcacaatatttaggtgtattttcaatacctccagaaaggaaacctcagttaatcagaggaaatagtttcagtcttcatttgagcatgtctttccatctcaaaaaaatactcttagtaggttggagtgaagatagcaaggttttgaagcatatttgtcctaatccacagtgacactttttatcttccaggagcactcctaggaggttccgtgcctaatcaatgttgactgctttgcagatctcaagggaataaaatgacaaaagcagggaaagttacagattcaaacagcattttaactcatgttgatctggataattaatcttttctaaagatgtgtagtttcttggaaaacagtgatatcacatgattaaaattacatttttatcaacataattgtctggaaaagataagcccctcaattttctaccagttgacttttattcattagatacagaaggtgcagtattacacatcaccagctgcctttgtgaatggctcactacacagccattggggtacaactgtgtgcatgggcagaaacagcaagtgccctcattgtggtcattgggtggggagtgccttttgtcaaggagtctgcaggaattggcttatttctgtatgccaaagtgatcaacacaccaaagtctctgccataaagaatgtggcttccttgcatcctccatcctgttactctgggcccagtaatttgatgtaactgtctgattgtactagagacaggagtatacccagcttattcataatcaagtaaagagactcagattagatttgattttttagcctcctctagagccaatcaggcagttaagagtaataaaggaaaagggtttggtcacaaaccctaccattatctggagattacttcctgctgcactcctgtcttgccatgcacgtcttgccccctcacttttgctcagcctagcagtctacttcactttattgccttgtaagtgtcaggcctcctgggcgctctggaaaagacagggagccaggccctctcacccctactggtaacaggtcattgctgggtgcacaagagggaggtgatttgcatcatggtcatgctgcatgggcttcactgggatgctgttaaacaccagaggagccaacctatcagaatcccagcagcaaaggaaaactcagattttagaggctttttacaataaagtagcgtaactctaggtcatgattgatttcaaatgcctgccatgaatgatttgtaagtaattatgtaggatccatcaaagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggaggggaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggcagtggacctgtgaagagggagaatctagccttcagcctgtccagtgttaaccactagagaaactgagctttatatccttttttaatgcctgtgaattttagcatattgaaacattagagcaaatactcaggggatttttcattaaacatccctcagataatttagctatatatcattagaaagggaaagctatcatttttattttaaaactaaacaaggccatcttataaactgtcaccaaagtcttcccttttttattgcatgtgtgccttgaatttcataaaacattaattcacaatgggggtcagaatgtactcttgttgaaacacttcttgtaccattttatgttcatattatgtttgagagggtaaaaatgtatgagcagcttaactgaagtagaactattcatgatgcttttcacacattgtggcataagatgtaaagtttgtaattaatgttaatttctgtgcattttaatattcttttataattattaatgttaatttctgtgcattttaatattcttttataattatgagcattttaataaattcatttttacaaacaata

SEQ ID NO: 1123 - DNA, 5955 bp, Homo sapiens
  ENST00000441606
ttggggcagaggaggcttgtaggaataggggaagagttcataagcagagctgaaacaacaccaaacatggaaatgttacaaggtggagaaattgtgcttactgaaactcttctcagaaatattgctgtttgtggatgatagaaatcttcagagttgtcacttaaggtagaggtaggagggtaagaagcgtcaaggactcaccgaattgtccattcccccttttgttctgctgtggaatgttttgtgctgctgtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagcacgtcatctactctgtgaaatttttcatttcatatgcaattcccgatgtatcaaaacgcacaaagagcaagatccagagagaaaaatacctaacccaaaagcttcttcatgagaatcacctcaaagatatgacgaaaaatatgggggtgatagctgagcggatgatagaagcagtagataacaatttacggccaaaatcagaataagagctttatgttctgagaagcactttaaggaatttagctttgtcaaaatatattaggaatcactaatgagaatgtgtaagttaaatcactttggcaaatatgagtctcaactattgccatttcctcatgtattatttttcagtttcagctagcgatgcagaaactggaaaatgtaaaacttagatcatgaagggcataaaacttatcacccggaaaacctcaatgttacctttttctgataaattggaattttacagaaaaagtccctcagtgtgcttaaaaaccaccccttctaaagtagaatggattcttttttttctgtttgattattttcatttctgtctattctcaggcgcatgatctcctttatttttaagccatgtttcatttcttcacttggctagatctgttccagggtcatcttttccttacagtaccatcattatagatttaatttaatagctttcatgtgattaaaaatagctaactagactcaaggattcacaatatttaggtgtattttcaatacctccagaaaggaaacctcagttaatcagaggaaatagtttcagtcttcatttgagcatgtctttccatctcaaaaaaatactcttagtaggttggagtgaagatagcaaggttttgaagcatatttgtcctaatccacagtgacactttttatcttccaggagcactcctaggaggttccgtgcctaatcaatgttgactgctttgcagatctcaagggaataaaatgacaaaagcagggaaagttacagattcaaacagcattttaactcatgttgatctggataattaatcttttctaaagatgtgtagtttcttggaaaacagtgatatcacatgattaaaattacatttttatcaacataattgtctggaaaagataagcccctcaattttctaccagttgacttttattcattagatacagaaggtgcagtattacacatcaccagctgcctttgtgaatggctcactacacagccattggggtacaactgtgtgcatgggcagaaacagcaagtgccctcattgtggtcattgggtggggagtgccttttgtcaaggagtctgcaggaattggcttatttctgtatgccaaagtgatcaacacaccaaagtctctgccataaagaatgtggcttccttgcatcctccatcctgttactctgggcccagtaatttgatgtaactgtctgattgtactagagacaggagtatacccagcttattcataatcaagtaaagagactcagattagatttgattttttagcctcctctagagccaatcaggcagttaagagtaataaaggaaaagggtttggtcacaaaccctaccattatctggagattacttcctgctgcactcctgtcttgccatgcacgtcttgccccctcacttttgctcagcctagcagtctacttcactttattgccttgtaagtgtcaggcctcctgggcgctctggaaaagacagggagccaggccctctcacccctactggtaacaggtcattgctgggtgcacaagagggaggtgatttgcatcatggtcatgctgcatgggcttcactgggatgctgttaaacaccagaggagccaacctatcagaatcccagcagcaaaggaaaactcagattttagaggctttttacaataaagtagcgtaactctaggtcatgattgatttcaaatgcctgccatgaatgatttgtaagtaattatgtaggatccatcaaagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggaggggaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggcagtggacctgtgaagagggagaatctagccttcagcctgtccagtgttaaccactagagaaactgagctttatatccttttttaatgcctgtgaattttagcatattgaaacattagagcaaatactcaggggatttttcattaaacatccctcagataatttagctatatatcattagaaagggaaagctatcatttttattttaaaactaaacaaggccatcttataaactgtcaccaaagtcttcccttttttattgcatgtgtgccttgaatttcataaaacattaattcacaatgggggtcagaatgtactcttgttgaaacacttcttgtaccattttatgttcatattatgtttgagagggtaaaaatgtatgagcagcttaactgaagtagaactattcatgatgcttttcacacattgtggcataagatgtaaagtttgtaattaatgttaatttctgtgcattttaatattcttttataattattaatgttaatttctgtgcattttaatattcttttataattatgagcattttaataaattcatttttacaaacaata

SEQ ID NO: 1124 - DNA, 567 bp, Homo sapiens
  ENST00000551667
attttttgagtgctgacttgacgttcaaaagaaatgcttagtggatcattttggattttcagatgtgggatgctcagctgaggaaaagacaagcatacgaatctaaccttatctgtcatggcctgcagttagaagcaacaagatcagtaagtactggtcccttttcagccctcggctgaccactgttctcgggcagcttcgtgccacttggaatacttgggtgacattggaaacatgcagccctggccacatcttagtcatagactgggagaggagtcaatcaaaatctgcattgtgtaggatgtattctttttttctgatcaaaactagcagatcttttttaatagccaacgaattttacaatgaatgcatgtatgaatgattattttctttctttaagaaacttctaaaagcttttttgttatacaaaaaatagtttatggtaaaaaattagaaaacataagaataaggaaaataatctgtatcttaattatccataaataattttgcagtccttctgagctgttttactcaaaaatatatatgtacacattttttatctttcaa

SEQ ID NO: 1125 - DNA, 1657 bp, Homo sapiens
  ENST00000264908
attgcagtacatttgagaaagtaaaggtgtagtggaaaccgagagcgaaatgagggcgtagggagaaaagggtggggaagcttagagaccggtgagggagcagagctggggcgcctgtgtacagggatagagcccggcggcagcagggcgcggcttccctttcccggggcctggggccgcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctactccattaaatataaagcaagat

SEQ ID NO: 1126 - DNA, 1335 bp, Homo sapiens
  ENST00000512884
ggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctactccattaaatataaag

SEQ ID NO: 1127 - DNA, 307 bp, Homo sapiens
  ENST00000512542
cggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctggggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaa

SEQ ID NO: 1128 - DNA, 1524 bp, Homo sapiens
  ENST00000503570
ggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctggacacggtctcactctgtcacctagactacagtgcagtgacacaatcacagctcactgcagccttgaccttctgcgctcaagtggtcctcccacctcagcctcccaagtagctgggaccacacctgcacaccaccacacctggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatc

SEQ ID NO: 1129 - DNA, 571 bp, Homo sapiens
  ENST00000510502
agcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaaggtatgagccccccacaagccatttctgcccagggtttgaccaagtcatcaaaaatagtgactttcttgcagtgcacacttgtgatgggtggacttggatgcccttttggtctggactctcccagtggtaga

SEQ ID NO: 1130 - DNA, 545 bp, Homo sapiens
  ENST00000512373
actcgcacaccagtttcccccaccgcgctttggctagcagcgtaagggatccacttagccatctcggcctccccagtcctaaaggtctaggggacagaaaaaagctgggagtcggaaggttcctcgggtccccggcatggcagacggggctggctcagaggtctgctctgtggacttggaatcgcacccatcctattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagg

SEQ ID NO: 1131 - DNA, 880 bp, Homo sapiens
  ENST00000514171
ctcgaccctgggcagggctggcggctggcgcccgcgcccggccccaacccagctgcgtgggtggggagctggagggacctcagtcctgcatttcagagtcgaggagactgggcccacgggggggaaagtgccgtgccatgggtgggtcacccaggtcttggtggggcccaagctgatactcagctgtcctcgctccctgaaagcttcgcttattacagctagcagcgtaagggatccacttagccatctcggcctccccagtcctaaaggtctaggggacagaaaaaagctgggagtcggaaggttcctcgggtccccggcatggcagacggggctggctcagaggtctgctctgtggacttggaatcgcacccatcctattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaag

SEQ ID NO: 1132 - DNA, 567 bp, Homo sapiens
  ENST00000508214
cctcctcaaagagcagatgtgtctttataacagactgtaggcttggagccttgtaaaatgtacatggagtttcacaatcaagcacaaggaatccaactgaaggcagctaaactttgtgttgatttgattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacag

SEQ ID NO: 1133 - DNA, 832 bp, Homo sapiens
  ENST00000505805
gagaaggggaaagagaaagagagatcattgaagaaaatcatctagggagtttgggttttgttgtagatgatttccttaaaaaggaacaaaagaaaaacaaaaacttctgtgcccagattttcatggtttaaagagggagttttttagcttgctacttgatcttctgcatatcaaataaaaaactagaatatattcaaatgtgctcaactgcgttgctttaaataattttgtggtgcttctttttagcatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatat

SEQ ID NO: 1134 - DNA, 2932 bp, Homo sapiens
  ENST00000503776
agatgctaatattccacttgtatgaaagatgaaaattcatgtataatattaaattttaaaagttcatcctctattttaaatagaaaatgagaaggcaggccaggcgcggtggctcacgcctgtaatcccagcattttaggaggcccaggcgggtggatcacaaggtcaggagttcaagaccagcctggccagacggtgaaaccctgtctctactaaaaatacaaaaattagccgggcgtggtagcagatgcactgtaatcccagctactcgcgaggctgaggcagagaattgcttgaacccaggaggcagaggttgcagtgagcctagattgcgccactgcactccagtctgggcgacagagtgagactctgtctcaaaaaaaaaaaaaaaaaaagaaaatgagaaggtaaaaatatggcttaatgttgatagaatgtcatatttcttttccacttagattagttttctacagtagctaatttgtctactgatttgcctcataggttaatagtattctaacccatatagagataggtacagagaagtattgaccacattattttcactgcttcacagtaagtgcaggcagtaaaacttgttttagaatgccaaacctcaagcttgagacccagtagatcctgtggcctctcaaactgccttgcttaaaataaaccaagctgagttggcagcctttaatgatgccgtaaccctgtgtttgcttgtctgtctttactgccagatggtgcgctccatgagtacagactcctgtttatcctcagaccctagggccttgtgcacagaagatgcttacctccatctctttaccagccattttctgtggtcccacacgtaccttcaaagtcatatcctaagtgaacacatcctttccttcatctcgcccagccccacatctgctccccttcccctgttcagtcatcccagagaatggccccaacaggaatttgcccaactctctgaagtcgtaccattcctccccagacttcttgactatgcctcagccaccccaggcttctttccattcctcaactgtggcaagtctattctcacatcacagtctttgcatccattccttctctggaatgctcatcctctagatctttacctagctgactccttctcatctttcaggtttcagctctcctcctgagagaggtctcccctaactgtaccaggccaattggttccctttcagtcactctccatgccatttccagctttcttttcttcatatttctgatcactatttacttaagcaatagttaatttgctttgctgtctgtctccatctactagaacataagctccatgcagacagagatataatctgttctgttcaccgccattggcacagcacatggaataatgcctggctatagtcgacgctcataagcatttgctggatgaattacatagatgaatggaatatcatttagtatgttggccatcattaggtcaaaatccacctaactgctcagctagaaattttacactatctctctttttcattatcctgtagcgatacatcattatgttttgtcaatccatttacataagcaactctcaaatcttcccattttctccatccctactgcctttattctaaggatggccatcatcatctcttaattactcagtctcctcaagatgagtctcaaagcctctagtcttaactcccttatcttccttctactcctaccttgcaatctgtttctcatgctgcagtcaaagtgattttctgaaaccacgaatttgatctgatctcaacattctcatgtttaaaatattacaagagctctccacacttaggataaagtcagaatttcatttcatggttaacaaggtctggcctttccagacacatttctttttatccctctttgttaacttacgtatccttgaacgtggcgttctttattgccctaaaccttcacgcctgctatttcctctataggaagtttctctcctccctacatgaacctactccttcctcttgttgactgtttagtccttgcttaaatgtcactttctcagacttttcctaatccctaatctttcttaggcccccctgaagtatgctcccatggtacccaatattttcaacatgtcagactgttttgcaatggcttactttcttgcctgtattctttacaaaactggaagcttaacatgggtatctcatctctgctttgcagcatttagcatgatgctgtcacagagtaggtgctcaacaaatatttcttgaataatgaatgatgagtttgataataaatgaaaaagaatcactatagttgaatattttgcacaccattatctgattcttataaatatagatctctatgttgctttgtgaccaatgacatttgtgttgtgaacacctgcattccttaacagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctactccattaaatataaagcaagataataaaaattgttgcttttgttaaaagtaa

SEQ ID NO: 1135 - DNA, 5074 bp, Homo sapiens
  ENST00000374700
acatagagggcgccagtgacgcccacacacgtgctggtgtcccgggaagagttcctggcaaagagctcaggaacgttggatcttaatcaaggctttctccgtcggggtggatgggttggactttaggctccagcaagccccgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtggggcctgaagtgaaatttaaaggcgtctttcacccagttataatttctcctgatagaattgaagaactgagtgttgtaaaccatgcatataatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaaggatgcctgtcaaactcttctaaaacgcctcgaacccatcatcagcaagaatcctaaaggaacttggaaagactgggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatatccgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaa

SEQ ID NO: 1136 - DNA, 581 bp, Homo sapiens
  ENST00000454629
tttgagcagtgactgggatgcagtgaggagcaagccatgcaaacatctggggagacagcatccaggcagtgggaatggcaggtgcaaaggtcctgaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatg

SEQ ID NO: 1137 - DNA, 665 bp, Homo sapiens
  ENST00000485965
attcttttggaacagacaaaaaaaatagttctccaaagccttgcttaatccttattttagcacttgcttttttatgattacataaatgaaaataactcattatttttaaaagtctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatgg

SEQ ID NO: 1138 - DNA, 3142 bp, Homo sapiens
  ENST00000465297
acagacaaaaaaaatagttctccaaagccttgcttaatccttattttagcacttgcttttttatgattacataaatgaaaataactcattatttttaaaagtctttagggggacacatcattagcaggcatccagattcagatctgaatcccatcctggctgtgggtaactgtaccctcaacttgctatcaaaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaaggatgcctgtcaaactcttctaaaacgcctcgaacccatcatcagcaagaatcctaaaggaacttggaaagactgggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctat

SEQ ID NO: 1139 - DNA, 3213 bp, Homo sapiens
  ENST00000485106
aaagccttgcttaatccttattttagcacttgcttttttatgattacataaatgaaaataactcattatttttaaaagtctttagggggacacatcattagcaggcatccagattcagatctgaatcccatcctggctgtgggtaactgtaccctcaacttgctatcaaaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccaggtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaaggatgcctgtcaaactcttctaaaacgcctcgaacccatcatcagcaagaatcctaaaggaacttggaaagactgggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatatccgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatata

SEQ ID NO: 1140 - DNA, 452 bp, Homo sapiens
  ENST00000472553
ggctcttgccaggagttatataaaccccagagaatgcctgctaggtaaaagaggttacctcacttactttttttctgttttagacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggt

SEQ ID NO: 1141 - DNA, 580 bp, Homo sapiens
  ENST00000260930
agcaagaatcctaaaggaacttggaaagactgggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggat

SEQ ID NO: 1142 - DNA, 673 bp, Homo sapiens
  ENST00000439380
tactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgggagcacatggcaagcctgtcaggcggacacaggaacaggtgcttttgatacaacttcacaagattcagccaatgctggtggcataatgtcacattccaaggcgtcagatgaacttggtttgtttgtatgtgaatggaagaacagtaagttttctacattattaataaattcatataaagaaagaaa

SEQ ID NO: 1143 - DNA, 1785 bp, Homo sapiens
  ENST00000443700
cacactttcagtgccagggcattgtgggaagcagccatggtctaagccgggcgcctcacctgtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatgtctgtgagctggatattatctttaattttgaaaaggcttatttcatcctggacgagtttataataggtggggaaattcaggaaacatccaagaaaattgctgtcaaagccattgaagactctgatatgttacaggagaatcgtttgagccccagaggcagagattgcagtgagccgagatcatgccattgcactctagcctaggcaacaagagcaaaactccatctaaaaaaaaaaaaaaagaaaagaaaaaggagaattatgaagaacttggttccacaagtaagatagtcctcatactgcatcagtagtgacttaaacttttttaaaacttttattttttgtggggggatctgttgaatttgggaagcctccagttttaataaaatttttttattatggtggaaacatgtctgtaaaacttaggactatagaaatgcaaagaataaagaactgagggagttacacacatttgtagtcagaaattaagttcaaaaaataatttaggtcatttgcattttttagtatgcaaaataaatggaaaaattaaagtgcaataaaaatataatttgggaaatgaatgcagtaaaattgaaaacattgaaatattataatttaataaaataaacttcaaaaaatgtatgaaaatataagtatctttacttatataggattaaatatatttctgataatctgtcctctataatgaattggtttaattatgtttttctgtttttagaaatgggcatctttttatttctggaaacaactttttaatgagattttatcaaacattagactatgactaattataatattcaaagccaataccaaaacgatggataaataaatgaataaaacaaggcacattaatagaaaaaaatgaatgaaatcaattacgggttctacttgaaacacctaatctcattataatagcaataataaaacaatttgtacatactttattagtcgaacatttattaaaaatataagagcatagagcaaattaatttggaagaaaatttaaatcttttacatacaaataccctcaagaataataaatcatggagtattaataaaattaaaccagctgataattttagaaagtgcttcatgcacagagacttttattcaagtcctctttgctttctgctagtgcttttttttttttcttgaaatgggatgggatctcactctgtcacccaggctggagtgcagtagcacgatagcagcgcactgcaacctggacctcctgggctcaagcaatcctctcaccgcagcctcctgagtagctggggctacaggtgtgtgccaccatacttggctaattaaaaaaaaaaaa

SEQ ID NO: 1144 - DNA, 2515 bp, Homo sapiens
  ENST00000415298
ggaggagaaaggggaaaggaagaaagaaggagagcaggagggcgaggagcggggggagcggggaggagggcgcggggaggaggcagcggggaggagcgtgcagggaggaggcagccgcgctgggaggagtctgcacactttcagtgccagggcattgtgggaagcagccatggtctaagccgggcgcctcacctgtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatacttggccttttgcaagagcctgaagaagtttccttgaggtctgtgagctggatattatctttaattttgaaaaggcttatttcatcctggacgagtttataataggtggggaaattcaggaaacatccaagaaaattgctgtcaaagccattgaagactctgatatgttacaggagacaatggaagaatacatgaacaagcctacattttaactggaaatctacttgaagactccagcactacatgttatgaagctgtaaataagcaacgcctcccatccggttttttgatggagcctcaggcaccatgccaaaaataatttaaagggattctttgttaactaacaaagttaaagttgtttaacatatttataattactatgtgtctgtattattaaaaaaaattatgtgtctgtgttatactgtataggtacttgtagctctaaatgtttaaagtaactaccacctaacccaacagacaatatttgtaatgtattaactccatgttatgtttttaagctggtttagatacattagctgcaattttttttgcatttgacacaatattgtaataatccatgattttgaatgtaaagtatatatgatgtcattaatactttttctaaatgtttagttttctaaattgtataataattcaaaattatgttaatagtgcagagtttatatgtaatgctagacatttttcatacacttaatagtactgtaactgcaattcacatacaaaatgtctgattttaatgtgctgaattcatttattttttttagaattgggattatgaaaataaccaaagagtatagaacttaataagtgtttttgatgccttagaagctgctatcttgactgaggttttaatttatcttttaattgaatataagggacattccaataaggttttctatgaactatatatttattaaggtttatagagacctagagatacagcatctatgacttcctttattattctaaaatagtatgataagaattaatagcaataataattattgctactattttttaaaattcacgttccaagcactcttagatgctggaaatttcatttcaaatatgttttaatgtatctctaatgcatttgaagacttattacatggcttacttagagcatttaagattatcacagcctatatggtagattcctttccttcttttttcttttcttaccctttcctccccaaagaaaagatttgctgctgaccattattactgtaagtatatcacatttgtgcttcctggaatgaaaattctgtataaccaggtcctaacagtgatcagacatattacagggaaatagcttgtaggccgggagtggtggcttacacctgtaatcccagcactttgggaggccgaggcaggtggatcacttgaggtcaggagttcgagagcagcctggccaatatgatgaaaccccatctctactaaaaatacaaaaattaggccgggtacagtggctcatgcctataattccagcactttgggaggcagaggtgggcggatcacaaggtcaagagatcaagaccatcctcgccaacaaggtgaaaccccacctctattaaaaatacaaaaattagccgggagtggtggtgcgtgcctgtagtcccagctacttgggaggctgaggcaggagaatcgcttgaacctgggaggcagaagttgcagtgagctgagattgtgccactgcactccagcctgggcgacagagcgagacttcgtctcaaacaaacaaaaaaattagccgggcatggtggcaggtgcctgtaatcccagctactcagggggctgaggcaggggaatggcttgaacccaggaggcagaggttgcagtgagccaaggtcataccagtgcactccaggcgggtgacagagcaagactgcgtctcaagaaaaaaaaaaaaaaaaa

SEQ ID NO: 1145 - DNA, 2201 bp, Homo sapiens
  ENST00000334271
agccatggtctaagccgggcgcctcacctgtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtctgtgagctggatattatctttaattttgaaaaggcttatttcatcctggacgagtttataataggtggggaaattcaggaaacatccaagaaaattgctgtcaaagccattgaagactctgatatgttacaggagacaatggaagaatacatgaacaagcctacattttaactggaaatctacttgaagactccagcactacatgttatgaagctgtaaataagcaacgcctcccatccggttttttgatggagcctcaggcaccatgccaaaaataatttaaagggattctttgttaactaacaaagttaaagttgtttaacatatttataattactatgtgtctgtattattaaaaaaaattatgtgtctgtgttatactgtataggtacttgtagctctaaatgtttaaagtaactaccacctaacccaacagacaatatttgtaatgtattaactccatgttatgtttttaagctggtttagatacattagctgcaattttttttgcatttgacacaatattgtaataatccatgattttgaatgtaaagtatatatgatgtcattaatactttttctaaatgtttagttttctaaattgtataataattcaaaattatgttaatagtgcagagtttatatgtaatgctagacatttttcatacacttaatagtactgtaactgcaattcacatacaaaatgtctgattttaatgtgctgaattcatttattttttttagaattgggattatgaaaataaccaaagagtatagaacttaataagtgtttttgatgccttagaagctgctatcttgactgaggttttaatttatcttttaattgaatataagggacattccaataaggttttctatgaactatatatttattaaggtttatagagacctagagatacagcatctatgacttcctttattattctaaaatagtatgataagaattaatagcaataataattattgctactattttttaaaattcacgttccaagcactcttagatgctggaaatttcatttcaaatatgttttaatgtatctctaatgcatttgaagacttattacatggcttacttagagcatttaagattatcacagcctatatggtagattcctttccttcttttttcttttcttaccctttcctccccaaagaaaagatttgctgctgaccattattactgtaagtatatcacatttgtgcttcctggaatgaaaattctgtataaccaggtcctaacagtgatcagacatattacagggaaatagcttgtaggccgggagtggtggcttacacctgtaatcccagcactttgggaggccgaggcaggtggatcacttgaggtcaggagttcgagagcagcctggccaatatgatgaaaccccatctctactaaaaatacaaaaattaggccgggtacagtggctcatgcctataattccagcactttgggaggcagaggtgggcggatcacaaggtcaagagatcaagaccatcctcgccaacaaggtgaaaccccacctctattaaaaatacaaaaattagccgggagtggtggtgcgtgcctgtagtcccagctacttgggaggctgaggcaggagaatcgcttgaacctgggaggcagaagttgcagtgagctgagattgtgccactgcactccagcctgggcgacagagcgagacttcgtctcaaacaaacaaaaaaattagccgggcatggtggcaggtgcctgtaatcccagctactcagggggctgaggcaggggaatggcttgaacccaggaggcagaggttgcagtgagccaaggtcataccagtgcactccaggcgggtgacagagcaagactgcgtctcaagaaaaaaaaaaaaaaaa

SEQ ID NO: 1146 - DNA, 830 bp, Homo sapiens
  ENST00000396654
attgtgggaagcagccatggtctaagccgggcgcctcacctgtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatgtctgtgagctggatattatctttaattttgaaaaggcttatttcatcctggacgagtttataataggtggggaaattcaggaaacatccaagaaaattgctgtcaaagccattgaagactctgatatgttacaggagacaatggaagaatacatgaacaagcctacattttaactggaaatctacttgaagactccagcactacatgttatgaagctgtaaataagcaacgcctcccatccggttttttgatggagcctcaggcaccatgccaaaaataatttaaagggattctttgttaactaacaaagttaaagttgtttaacatatttataattactatgtgtctgtattattaaaaaaaattatgtgtctgtgttatactgtataggtacttgtagctctaa

SEQ ID NO: 1147 - DNA, 589 bp, Homo sapiens
  ENST00000396653
attgtgggaagcagccatggtctaagccgggcgcctcacctgtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtgtctgtgagctggatattatctttaattttgaaaaggcttatttcatcctggacgagtttataataggtggggaaattcaggaaacatccaagaaaattgctgtcaaagccattgaagactctgatatgttacaggaggtcagtacggtttcccaaaccatgggagaaagatgatgatgatgatgatgatggtgttaataattataatattaaccagacttactgagtacttactctgtgctgggtacagtttctaaactatttatatgtatt

SEQ ID NO: 1148 - DNA, 499 bp, Homo sapiens
  ENST00000446015
ctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatgtctgtgagctggatattatctttaattttgaaaaggcttatttcatcctggacgagtttataataggtggggaaattcaggaaacatccaagaaaattgctgtcaaagccattgaagactctgatatgttacaggaggtcagtacggtttcccaaaccatgggagaaagatga

SEQ ID NO: 1149 - DNA, 561 bp, Homo sapiens
  ENST00000444408
aaacgtttgcggaaggaatacaggacacactcgcgcggcagaatcgcgaaaagtccccggtgttctccgcgcagggagttccccgcgcagggagttcctagcgggccacgcgctctcgcctgaccacccgcgccgagctgcgggctgtcggggtacagacgcccgcgcgcgcaggtgcattcgctccagatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggaggctattgggggtgatgaataatgatttcattcttggatgaggagaggctcggcgggggaggaggtgactgcatattcgtgggaaaaactgtctccaggttgcttaatgtctgtgagctggatattatctttaattttgaaaaggcttatttcatcctggacgagtttataataggtggggaaattcagga

SEQ ID NO: 1150 - DNA, 552 bp, Homo sapiens
  ENST00000409375
gtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatgagtttaattgctggtttctcctaatgaggctcctgtctgtcttggattcctggtctacgcctgccttgaactccgaggttcctcagcttgctactataactcctgacttctgccttttctgacctctggtctgtgagctggatattatctttaattttgaaaaggctta

SEQ ID NO: 1151 - DNA, 535 bp, Homo sapiens
  ENST00000632247
aacaaccgctgacttcctggttcctgggtgccgcatcactgcccctctgctccgggtcaaaccggctgtatgcttagcttcaggaacatgtggcaggtggcagcccccggccccgtggcagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggg

SEQ ID NO: 1152 - DNA, 217 bp, Homo sapiens
  ENST00000631794
tctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccgga

SEQ ID NO: 1153 - DNA, 2436 bp, Homo sapiens
  ENST00000633212
tctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattgtgagttccccctcctgctctgggccaccaccaccactgcagggcccagggagggggagcagctcccgtccaatggggcaggctatgtctggcagcctggtaggacctggcctgtggttgcagctgcccacagccaggccacctggggcaggaactttccatggctctctgggaggtcctggctagaaggggagggccagggcatggccgtggattgggcccctccagcct

SEQ ID NO: 1154 - DNA, 3006 bp, Homo sapiens
  ENST00000612449
tctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaacatgaaaa

SEQ ID NO: 1155 - DNA, 3011 bp, Homo sapiens
  ENST00000631894
tctcctgaatatttacgcgttgctgaatctcctgtggacaaaccaccaataggccaggactgtcctgtggacagacgggaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaacatgaaaa

SEQ ID NO: 1156 - DNA, 3640 bp, Homo sapiens
  ENST00000620457
tctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccggccagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgaaaa

SEQ ID NO: 1157 - DNA, 711 bp, Homo sapiens
  ENST00000632415
gcagatgagggcctgcttgggtctggggcgtcagtggggattggctgcaggcagccatgaggagccttcagggtgatgagggttctaaaagtgcgtcgtgtgcctgagccactgcgacattcactagaagtcctccgtgctgacggagggtgaactgtgtggggcccaagttctatctcaggaaagccagggaagccactcagttcagctttgtgaaaatcaagggagtcttcttggaggaagtggactctgagctggatgtgaatgacggagtgtctttgaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagag

SEQ ID NO: 1158 - DNA, 554 bp, Homo sapiens
  ENST00000631996
cagctcagccccactgcaaggagctcctgggtttatttaagtgagcctcagataactttacataaaagcaaatgtgtaaaaagcgataaagtcagatatattgaacatttgtcctgagggcaaatttctgagctctaaaagccagtttggttttagataacatctgtgagtctggaaacaggctgagatactctatatctgcactcccaactctgcctttggctttgtgagccctgtggtctccttgaaagaattggtccccagtgggtgaactaatcacccatgaagagtctcccaattcaaatctggaataaaaagtgaggacatgggggcagaatgttactcatcacatgtggcccgtcagtactagacttcaagaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccagg

SEQ ID NO: 1159 - DNA, 936 bp, Homo sapiens
  ENST00000632681
agtggtgagcacggtgtcgggggccgcattagctattgatttatgtgctgttatagaattaattgagtctggacatggagactcattttcttggacatgtagcagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggc

SEQ ID NO: 1160 - DNA, 1954 bp, Homo sapiens
  ENST00000632204
gaaagaagacgtccacgctgctgagtgagaccttcctctgtgctgctgagtgagaccttccatctgaccagggggtcatgctctcactgctcctgcttggagttctggtgctgtagcgggtctcggccgccccttctgagctgggtggaggaagaagtccctgttgaaatatcagatgagtagggatgatcgcctcttttgaaaacaggagccgtgaagggattcccagagaagattgtcatctaacggagtcattcgtccgcccaggacttctctgtcacagggttacgtttgggagaattttcacaggccactggggatggctgtggctagcctggctttccactgatgccctctatccctaacctcagctcctgacatggctgtcattccagagagtgcttggaagcatcctgactatgttgacgatggcctgagcggagtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgtaagtaagcccttgccagggcactcccctcccaaagttcacagcccagggcggctccaggatccaggcgctgtggaaaccaccctcaggtggaaagcctccatgctgttactgatgtttccagtggatcagtgatcttttgcatactctttgggtttgcaaagatagtgaatacagttttattctacttcttgaaataggttcttcaggagctgtttataaattgagttgtggttaaatatatgagggagctatttgaagaaatccctttacaaaacattttctctactaaaaatgaagttaatctttgcataacttttgttattaaaatgcaaattttcgcatggccctggcatgctgtataaagaaagcacatctgcacatgaggcttagttctgcctttgcgtgtggtcttcagaggaagtaaaaagtgattctgaagtataagataccaaagactcaggaaaagatcacaagccctttggctccctccttggctggagaagagtgttgtttttagcctggagggggacagaggggctgaggaaggagcagcagggccaagaggggagctcagagaggaactgtccttcctggaggctgatcttactcacagaccagcagggggcgctgctggtgagccagttttgtggctgttgccagagtgaaattttaaaatatgatctatggctgggcacggtagctcatgcctgtaatcccaacacttttgggaggctgaggtgcgtggatcacctgaggtcaggagttcaaaaccagcctggccaacattgcgaaaccctagtctctactaaagatacaaaaaaattagccaagcttggtggtgcgtgcctgtaatcccagctacgtgggaggctgaggcaggagaattgcttgaacctgggaggcggagattgcagtgagctgagatcgtgccattgcactccagcctgggtgacaagagtgaaactccgtctc

SEQ ID NO: 1161 - DNA, 3138 bp, Homo sapiens
  ENST00000561069
acataacagtaaggcaagaagatgactgcatttatcttctcagaatcacttcttcttaattgttgcttcccactattggcattggtgaaaggctgggccacaggaggctggatgaactttgtgttagccagtctcctgaatatttacgcgttgctgaatctcctgtggacaaaccaccaataggccaggactgtcctgtggacagacgggaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaa

SEQ ID NO: 1162 - DNA, 4031 bp, Homo sapiens
  ENST00000558402
agtgtgcccggcgcgggtgaggcggaagcggccggggcgggggcgcaggcccggcagccgcaggccggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccaggcggagggagctgttcatcctctgggggctgctgggccagaaatatctcttacctgataatgtcaggcatcagaggttcctgtttcgtggtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgaaaa

SEQ ID NO: 1163 - DNA, 3349 bp, Homo sapiens
  ENST00000558330
gcccggcagccgcaggccggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccaggcggagggagctgttcatcctctgggggctgctgggccagaaatatctcttacctgataatgtcaggcatcagaggttcctgtttcgtggtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaa

SEQ ID NO: 1164 - DNA, 2555 bp, Homo sapiens
  ENST00000559814
attagcagtcgcggtgtgcggctcggcgcgggctcacaaagagctcggcctcgcggactgagccggcggcagcggggcggggacggcggcgtacccgggcagcccagcgccctggccagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattgtgagttccccctcctgctctgggccaccaccaccactgcagggcccagggagggggagcagctcccgtccaatggggcaggctatgtctggcagcctggtaggacctggcctgtggttgcagctgcccacagccaggccacctggggcaggaactttccatggctctctgggaggtcctggctagaaggggagggccagggcatggccgtggattgggcccctccagcct

SEQ ID NO: 1165 - DNA, 594 bp, Homo sapiens
  ENST00000559709
agcagtcgcggtgtgcggctcggcgcgggctcacaaagagctcggcctcgcggactgagccggcggcagcggggcggggacggcggcgtacccgggcagcccagcgccctggccaggcgtgcctgtgcttaatcagcactgacgactggtgctgcttcagttgatttgatacacctagaggcagcctcatctccaacttgccttgacttcgtctggggagctgccgtgggggacccctggactggcagcattcccacccctcactttggcaaccctggtctaactccgcggagggagctgttcatcctctgggggctgctgggccagaaatatctcttacctgataatgtcaggcatcagaggttcctgtttcgtggtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccgga

SEQ ID NO: 1166 - DNA, 535 bp, Homo sapiens; identical to SEQ ID NO: 1151
  ENST00000558804

SEQ ID NO: 1167 - DNA, 711 bp, Homo sapiens; identical to SEQ ID NO: 1157
  ENST00000560283

SEQ ID NO: 1168 - DNA, 554 bp, Homo sapiens; identical to SEQ ID NO: 1158
  ENST00000558206

SEQ ID NO: 1169 - DNA, 936 bp, Homo sapiens; identical to SEQ ID NO: 1159
  ENST00000558358

SEQ ID NO: 1170 - DNA, 1954 bp, Homo sapiens
  ENST00000382938
gaaagaagacgtccacgctgctgagtgagaccttcctctgtgctgctgagtgagaccttccatctgaccagggggtcatgctctcactgctcctgcttggagttctggtgctgtagcgggtctcggccgccccttctgagctgggtggaggaagaagtccctgttgaaatatcagatgagtagggatgatcgcctcttttgaaaacaggagccgtgaagggattcccagagaagattgtcatctaacggagtcattcgtccgcccaggacttctctgtcacagggttacgtttgggagaattttcacaggccactggggatggctgtggctagcctggctttccactgatgccctctatccctaacctcagctcctgacatggctgtcattccagagagtgcttggaagcatcctgactatgttgacgatggcctgagcggagtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgtaagtaagcccttgccagggcactcccctcccaaagttcacagcccagggcggctccaggatccaggcgctgtggaaaccaccctcaggtggaaagcctccatgctgttactgatgtttccagtggatcagtgatcttttgcatactctttgggtttgcaaagatagtgaatacagttttattctacttcttgaaataggttcttcaggagctgtttataaattgagttgtggttaaatatatgagggagctatttgaagaaatccctttacaaaacattttctctactaaaaatgaagttaatctttgcataacttttgttattaaaatgcaaattttcgcatggccctggcatgctgtataaagaaagcacatctgcacatgaggcttagttctgcctttgcgtgtggtcttcagaggaagtaaaaagtgattctgaagtataagataccaaagactcaggaaaagatcacaagccctttggctccctccttggctggagaagagtgttgtttttagcctggagggggacagaggggctgaggaaggagcagcagggccaagaggggagctcagagaggaactgtccttcctggaggctgatcttactcacagaccagcagggggcgctgctggtgagccagttttgtggctgttgccagagtgaaattttaaaatatgatctatggctgggcacggtagttcatgcctgtaatcccaacacttttgggaggctgaggtgcgtggatcacctgaggtcaggagttcaaaaccagcctggccaacattgcgaaaccctagtctctactaaagatacaaaaaaattagccaagcttggtggtgcgtgcctgtaatcccagctacgtgggaggctgaggcaggagaattgcttgaacctgggaggcggagattgcagtgagctgagatcgtgccattgcactccagcctgggtgacaagagtgaaactccgtctc

SEQ ID NO: 1171 - DNA, 3635 bp, Homo sapiens
  ENST00000558259
cagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatg

SEQ ID NO: 1172 - DNA, 3599 bp, Homo sapiens
  ENST00000411764
cagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatg

SEQ ID NO: 1173 - DNA, 8972 bp, Homo sapiens
  ENST00000295974
gccaaagcctggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcctcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcataaaacgttcggctcatttatctgacatcttagtcacatatacaaggaatagaaatagaaactcggtgtctctagttatttttaaattattcttacctcagacttcttagaaatcactttagtaatggagcattttgctttgattagttactacatatttctgcctggtaagaactaggaagtaacttcaaattttgagtaatcaccctgtacttatttggtgatcaggaaggccagctggccttccggacatagaagcctatttagtcaccaactcgagtcttttgtaagcggtcttgctaggattgtgatattttagcacgaagaagtttatcacttcctttaagaacctgacatcaaagaataaagaatagaggtgtacacacactaaatccaaaatgaaaggtaactagagaaatcagttgaatctggtttagcttaactgttaggcgcaggaaggcagataaacagaatttaaagtatgtccccgctttttgttcatcttgcacttccacagtggtttctctctagtcagtaacaaaatttcattatggtttcaggcattatatggtggtaaataatttcagattaaaaatgtgtttgctattggagtatctgaatactagtaatttcattatttagaattttgcagcacttttatctcaagaagaagtccaagaatgtaaaatgccaaatgaaacatgtcagtggaatcaatattctccttcattagaattccctcatattgctttttttttttttcttcagacagaggagtcttactctggagtgcagtggtgtaatttcagctcaccacaacctccacctcccaagttcaagcaattctcgcctcagcctcctgagtagctgggattacaggcatgcaccgccacgcctggccaatttgtatatttttagtagagacagggtttcgccacgttggccaggctggtctcgaactcctgacctcaggtgatccgcccgccccaacctcccaaagtatgtgagccaccacgtccggcctcatattgcttttatccaaaattcttttcccttttcactctaccaaagtatttaaataatcctgtccttcatagaagattctcaaagaagaaaactgcagtgtaattaatgaatggtttaattcagaatcttcatatacttctaaagagaaaaataatttagtgccaaatgcatgttaggagataatcaatgtaagtggcaacaaattgtgacttcacatgctactgtagagatcagaaaattatcctaaactattccataacaatgagacaacatcacagaaaatacacttgaaaataaaaatctcaagaccagctacttctggacaatggaatacttttcagtctggtatggtggagggcccgaaaaggataagggattcttatgatacacaatgggattctttactgaacaatatgttaaattaagctgcaccgccttccttgaggcatggactaccctaaccaaccagatagaaatctgggtgggataagaggatgagccacacgctataattttagggcaaggagatagtgtttgattttcaaaatcagcaaaataagctgagcactttatatctttctgtacaagagtgataacatgaagaattcttcttcagggatttaaaatacaataagcctggttcaactataaaaagtcttgtttcctttcttcattgacacttttttttttttttttttttttttgaggcaaggtctcactctgcttcccaggctggagtgcagtggggcaatattggctcactgcaacctgcacctcctggactcaagagatcctcgtacctcagcctcctaagtagctgggactacaggcgtgtcccaccacacccagctaatttttgtattttttgtagagatggggttttggggtttcgccatgttgtccaggctcgtctggaactccggtgctcaagtggcgtgcccacctcagcctcccaaactgctgagattacagatgtgagccactgcacccagcccactgacacgttttactgataaatgtaaatctaagctaaaataaaaataatgtattaccgctataatacaattcaccattctcttttctcacttcaagtaagaaagtaaaaatagaatatcagagctgaagtagacctaagtattcatcttgaagaagataatattctaaaaatcatgccacctgaattgagcatttaggaatttatgtaacatttctatacaactgaattgcaaaaataaaactttaaattcaaacttta

SEQ ID NO: 1174 - DNA, 4166 bp, Homo sapiens
  ENST00000513140
ctggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttata

SEQ ID NO: 1175 - DNA, 2964 bp, Homo sapiens
  ENST00000513611
tgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagcagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtggga

SEQ ID NO: 1176 - DNA, 3592 bp, Homo sapiens
  ENST00000508593
gcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagcagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcat

SEQ ID NO: 1177 - DNA, 1681 bp, Homo sapiens
  ENST00000502841
aacttgagcccggggcagtgcgcgcggctgcttgagcgacggcaccgctggctggtgccggcaccctggggcttgtcgtagcacctggggcggcatccccgcccgacttcggaaggaccgggaggcaaaggtgaggaagttggcgaaggaacggctctcctttgtttgcagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatc

SEQ ID NO: 1178 - DNA, 3316 bp, Homo sapiens
  ENST00000506352
aaagcctggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaa

SEQ ID NO: 1179 - DNA, 1274 bp, Homo sapiens
  ENST00000504305
aacttgagcccggggcagtgcgcgcggctgcttgagcgacggcaccgctggctggtgccggcaccctggggcttgtcgtagcacctggggcggcatccccgcccgacttcggaaggaccgggaggcaaaggtgaggaagttggcgaaggaacggctctcctttgtttgcagagagagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgat

SEQ ID NO: 1180 - DNA, 883 bp, Homo sapiens
  ENST00000502687
atcactggacgaagaaagataccgtgaatcccttttttctggtgctctgggggtttacttggccaaatgggttttgggccaccaggtgtcctgtatttgggctagatgtaagaagtatggacggcactgtccctccccacagtgaactcacagccacgtagcataatggagaatgggacccacatcacaccccatgacagcagtgtagttcagagcaagaatgacctccagaacagggtagccatgcagtgatggcctcttcagacatttgggcaaggttccgcctttcgagaaaaacacaggtcctttctgaattcggcctggctatactttctgaatgccagttcctatgtgctgccactcttaagcttgatcctgggatctcctgattggatgccgcataatgtctcttgcagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttac

SEQ ID NO: 1181 - DNA, 701 bp, Homo sapiens
  ENST00000510925
gtgacacaccagcaaaagccattgccacaagtctccacgagatctgctccaaggtaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcaca

SEQ ID NO: 1182 - DNA, 539 bp, Homo sapiens
  ENST00000512510
gtgctgcactcgcagcccatcgtcagcatccgcgtgtggggcgtgggccgcgacaatggccgagagagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgt

SEQ ID NO: 1183 - DNA, 591 bp, Homo sapiens
  ENST00000510670
agggagggcgcagggaggcgcgggcgccgctctcttcaacttgagcccggggcagtgcgcgcggctgcttgagcgacggcaccgctggctggtgccggcaccctggggcttgtcgtagcacctggggcggcatccccgcccgacttcggaaggaccgggaggcaaagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtg

SEQ ID NO: 1184 - DNA, 550 bp, Homo sapiens
  ENST00000514920
attaattgctgcagagttgggaaattagatgagctgtcagtgctcagactcgctgttaacggggctgtgttattggcgggatgccgtgtgaatgctaacgtgttgtttctgctctgttccctcacgccttcccggattcagagagagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaag

SEQ ID NO: 1185 - DNA, 575 bp, Homo sapiens
  ENST00000507831
gtgggtttggaaaggccatcgaggggatgcttggtaggatctggccagaagaatggggagagacaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccac

SEQ ID NO: 1186 - DNA, 537 bp, Homo sapiens
  ENST00000513516
aggcgcgggcgccgctctcttcaacttgagcccggggcagtgcgcgcggctgcttgagcgacggcaccgctggctggtgccggcaccctggggcttgtcgtagcacctggggcggcatccccgcccgacttcggaaggaccgggaggcaaagagagagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgcc

SEQ ID NO: 1187 - DNA, 426 bp, Homo sapiens
  ENST00000513493
ggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgagagagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagattttccaacaccaaagactgagctggtccagaagttccacgtgcagtacttgggcatgttacctgtagacaaaccagtcg

SEQ ID NO: 1188 - DNA, 856 bp, Homo sapiens
  ENST00000514094
cttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaaggtaagtcagtggcacctcatgtcttcattatggccctgtccctcctggtccaggactgaaggctctcagatggttctctggtatttcaagtctccttaaagagcacactcaactcagtaagcacaagttgagcctgcacgctgggtctcacagaggcacagagttgattttgcatcactagggttaggcataaagccaggatgagttttgttgttattggacaagattaaagaatattgtctttagtttttgccttcgttttcattttgttttgtattttatgttctttaagaatactgtcttcatattataattcatgtacaacctgggataaggaccctggctg

SEQ ID NO: 1189 - DNA, 1486 bp, Homo sapiens
  ENST00000509475
tgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccggtgagtccctgggtggggcagtctgggtcacctcacccgtgtccctggtctagct

SEQ ID NO: 1190 - DNA, 2091 bp, Homo sapiens
  ENST00000504484
cttttaagtgaaaatatcttgacccccaacttttggggccctcagccatgggcattccctagtttccaaacaaacacggtacccgtccctcattccacccccaccaccagaaaacagttctgtttggtttatagggaggaaaatgattattatggaattaggtatgctagttattgaatacttggaattatattgtttgcttttaaaattaccttaaggaaataacttcactgtctgcttctaataatgtttagtcatttatttggtaagtaattaaagcaccatcactctcctgccctcgtcttcaggtgataatctagacatagagggagtgagccaacaagttgctgttagagttaacttgttccctaacccatcttgtgaatatcaatgctaacaacagtgtcttgtgttttttttttttcttttcttttctttttctttaaatcaatgtgcttttttcctatgtgaataattatatgtctagaaacagccatggagtgattttgctgttctgaatgggggaaagattaatagtgacatttggaaggcaagtatattgtcagatcttagatcatttaatattttatcctttctgcatggctgtggctgtatatttttcttctttgtgaatatcatgcattctgcagggacacagtgatcgggcttcttgctaggggcattcagctcacactcctgttgcctttttttggtgtctcccattgtgaatgccctaggttccccgttgttttgtaagaacaggagtttgcaccagtcagcattcaacagtccttgcatgcctttctctgcctaagctcacgtacactctctgcctcttgctgggaagacgtttctcccctttgatatttgaggcaatgaatggtcttctcccccattgtacattaacaaggttctattttcctctaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggtaagtggcatgtagaatgatgcacggcaggctgtttacgttctcctgcatttcaggaagccccacagctcagtgacacatggtactgaggggctccgaggtgttcatcaggtgccttttcccattaatgcaggaagtgtaggcatggtacccccgtgtgactgatcccttagcactgccagatgccagtgaggactggggcctggagagagagcgtttctcagtagctaaggacacagattcacgggtgagctttaggggcccagaactcccctaaacatgcctgcaaaatgggatgtgccagtgtataagagcagttttgcagactggaagaaggacctgtattctcaaaggggaaggtgacttccacacgtccacacaaaaatgttgatgcctctgctttaaaagttgacaaattattcttttataacactcttctttacttagcgtctgaagaatcaacattatacatgaattgtggaattgatatttatatacttctcccttttaacagagtgattccattttgaaatgttagttgagataatttcagaaaggaaaaaataagtacagataccaaatgtgtatgaaactcacatcaaaccggaaaagctgtattcctggtgtgctctgagacctgtggaaaaagcattttgggagcatcttggaatagtgtttgctacatgaatagatagatgttgttctctctgcttctagtgaacagagcagtggtagaaaagtttgctttttggttgggctgattgggactccactcacattttctcctagcagcacatcccaatgggaagtaggtttccaagcctttccatggtggagtttgtctccttaaagtggagctgaatcactgca

SEQ ID NO: 1191 - DNA, 560 bp, Homo sapiens
  ENST00000511120
attatattgtttgcttttaaaattaccttaaggaaataacttcactgtctgcttctaataatgtttagtcatttatttggtaagtaattaaagcaccatcactctcctgccctcgtcttcaggtgataatctagacatagagggagtgagccaacaagttgctgttagagttaacttgttccctaacccatcttgtgaatatcaatgctaacaacagtgtcttgtgttttttttttttcttttcttttctttttctttaaatcaatgtgcttttttcctatgtgaataattatatgtctagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacc

SEQ ID NO: 1192 - DNA, 907 bp, Homo sapiens
  ENST00000509446
ccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggaga

SEQ ID NO: 1193 - DNA, 639 bp, Homo sapiens
  ENST00000508707
ctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaaatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaa

SEQ ID NO: 1194 - DNA, 493 bp, Homo sapiens
  ENST00000503264
caagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactgactcaggtgttgacaccttggcagtgtttatggccagcagcggaactacagacgtcacaaatcggaacagcccagccacaccaccaaacacccttaacctccgatcct

SEQ ID NO: 1195 - DNA, 604 bp, Homo sapiens
  ENST00000508676
ggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaaatttcaaattataacctatttcctgcaccattgctgacgcctggtgatccatgtcagaagtacttccagctgactcaggtgttgacaccttggcagtgtttatggccagcagcggaactacagacgtcacaa

SEQ ID NO: 1196 - DNA, 544 bp, Homo sapiens
  ENST00000503503
gatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagtctcactctgtcaccaggctggagtgcagtgacgtgatctcggctcacagcaaccgctgtctgccaggttcaagtgattctcctgcctcagcctctcgagtaactggaactacagatcgatctctttgggctgcctgacctccttgggtgcttgctattaattaacagactttgtggggaaaaaaaggagcttgccttctgagctttgtaccaaagacctgggaaaaatttcaaattataacctatttcctgcaccattgctgacgcctggtgatccatgtcagaagtacttccagctgactcaggt

SEQ ID NO: 1197 - DNA, 565 bp, Homo sapiens
  ENST00000506999
actcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcaggatcttgctccatcacccaggctggagtgcgtggtacaatcatggctcactgcagccttgatctcccaggctcaactgatcttccttcctcagcctcctgaatagctgggaccacagatcgatctctttgggctgcctgacctccttgggtgcttgctattaattaacagactttgtggggaaaaaaaggagcttgccttctgagctttgtaccaaagacctgggaaaaatttcaaattataac

SEQ ID NO: 1198 - DNA, 556 bp, Homo sapiens
  ENST00000503555
atttttgggtaagattcttttatgatttgataggaatatttttatctagccgctgaatggtccatgaaattgacagggaaactgaaacttcccaggctgtgcagctagtaggtgggacttggacccagaccaggtgtgtgtccatcgctgcattatcatctcttcataaaacaaagaatttaatattgtatgaacgaagataaggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttg

SEQ ID NO: 1199 - DNA, 619 bp, Homo sapiens
  ENST00000511572
actcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcaggatcttgctccatcacccaggctggagtgcgtggtacaatcatggctcactgcagccttgatctcccaggctcaactgatcttccttcctcagcctcctgaatagctgggaccacagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgct

SEQ ID NO: 1200 - DNA, 482 bp, Homo sapiens
  ENST00000502682
gcatttcagggattttgtgtgcccaggcagtgacttcccgacttctccggcgtatccccgacggggcgcagaacaccgcccgtggcgaagtcgggccgggggagtttgggaacccgtccccgggagctcagcggccagaggagggcgcggaagtgtttcctgggtgagcgcggcagcgggacccgtttccggaaggctgattgcatcaggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaac

SEQ ID NO: 1201 - DNA, 446 bp, Homo sapiens
  ENST00000505266
gtaaccgcatctgatctgggcgctccgggaagggcgagactggagcagagccgctgggcgccggagccgaggcgagcgccgcgcgcaccactgagatgcagtctcactgtgttgcccagaatggtttcaaactcctcaaagattgggctcaaagttcgggctcaagtgatcctcccgccttggcctcccgaagttcttggattacaagcttgagccactgcctggcctcaatttcactcttaacaaaatatttcaaatatacaaataatctaaaaagtggggactaatgttctagatactgatattcctaccacacccatcagaaaagaaatgcgaacactgttctagatgttttcagatttatctttacttctccattattgcagttatttttactatttttacttgtgccattcaacatacaccctcttacaactacttgctag

SEQ ID NO: 1202 - DNA, 6992 bp, Homo sapiens
  ENST00000543538
aacttgagcccggggcagtgcgcgcggctgcttgagcgacggcaccgctggctggtgccggcaccctggggcttgtcgtagcacctggggcggcatccccgcccgacttcggaaggaccgggaggcaaaggtgaggaagttggcgaaggaacggctctcctttgtttgcaggcacagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcctcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcataaaacgttcggctcatttatctgacatcttagtcacatatacaaggaatagaaatagaaactcggtgtctctagttatttttaaattattcttacctcagacttcttagaaatcactttagtaatggagcattttgctttgattagttactacatatttctgcctggtaagaactaggaagtaacttcaaattttgagtaatcaccctgtacttatttggtgatcaggaaggccagctggccttccggacatagaagcctatttagtcaccaactcgagtcttttgtaagcggtcttgctaggattgtgatattttagcacgaagaagtttatcacttcctttaagaacctgacatcaaagaataaagaatagaggtgtacacacactaaatccaaaatgaaaggtaactagagaaatcagttgaatctggtttagcttaactgttaggcgcaggaaggcagataaacagaatttaaagtatgtccccgctttttgttcatcttgcacttccacagtggtttctctctagtcagtaacaaaatttcattatggtttcaggcattatatggtggtaaataatttcagattaaaaatgtgtttgctattggagtatctgaatactagtaatttcattatttagaattttgcagcacttttatctcaagaagaagtccaagaatgtaaaatgccaaatgaaacatgtcagtggaatcaatattctccttcattagaattccctcatattgctttttttttttttcttcagacagaggagtcttactctggagtgcagtggtgtaatttcagctcaccacaacctccacctcccaagttcaagcaattctcgcctcagcctcctgagtagctgggattacaggcatgcaccgccacgcctggccaatttgtatatttttagtagagacagggtttcgccacgttggccaggctggtctcgaactcctgacctcaggtgatccgcccgccccaacctcccaaagtatgtgagccaccacgtccggcctcatattgcttttatccaaaattcttttcccttttcactctaccaaagtatttaaataatcctgtccttcatagaagattctcaaagaagaaaactgcagtgtaattaatgaatggtttaattcagaatcttcatatacttctaaagagaaaaataatttagtgccaaatgcatgttaggagataatcaatgtaagtggcaacaaattgtgacttcacatgctactgtagagatcagaaaattatcctaaactattccataacaatgagacaacatcacagaaaatacacttgaaaataaaaatctcaagaccagctacttctggacaatggaatacttttcagtctggtatggtggagggcccgaaaaggataagggattcttatgatacacaatgggattctttactgaacaatatgttaaattaagctgcaccgccttccttgaggcatggactaccctaaccaaccagatagaaatctgggtgggataagaggatgagccacacgctataattttagggcaaggagatagtgtttgattttcaaaatcagcaaaataagctgagcactttatatctttctgtacaagagtgataacatgaagaattcttcttcagggatttaaaatacaataagcctggttcaactataaaaagtcttgtttcctttcttcattgacacttttttttttttttttttttttttgaggcaaggtctcactctgcttcccaggctggagtgcagtggggcaatattggctcactgcaacctgcacctcctggactcaagagatcctcgtacctcagcctcctaagtagctgggactacaggcgtgtcccaccacacccagctaatttttgtattttttgtagagatggggttttggggtttcgccatgttgtccaggctcgtctggaactccggtgctcaagtggcgtgcccacctcagcctcccaaactgctgagattacagatgtgagccactgcacccagcccactgacacgttttactgataaatgtaaatctaagctaaaataaaaataatgtattaccgctataatacaattcaccattctcttttctcacttcaagtaagaaagtaaaaatagaatatcagagctgaagtagacctaagtattcatcttgaagaagataatattctaaaaatcatgccacctgaattgagcatttaggaatttatgtaacatttctatacaactgaattgcaaaaataaaactttaaattcaaacttt

SEQ ID NO: 1203 - DNA, 3809 bp, Homo sapiens
  ENST00000355285
gaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctatttttacatcatttgtcttaccttgttgagagaggagactggcttgttggcttctggttgttgcaggaggcatgtggcttcctgccttctcagtagacaggatcattaggaaaatagcaacatcaatcctgttacacaggagcagtgacacgggtggctgcagtgtggtacatgccacacaaatgatagagaaagtgcccgttcattgcagtttcctcttcctgggggacctgagccctgactcactgtcttattaggggcaggcggaagaagctgcactctggcatccatgccaccttctaagatgaacatgcagagacagaacttcagctgctcagagagagtgcagtgggcatggtctgccctgggggcttgctccattacaccctgacttggcatgcaaccgagtctttgtgtaaagccatcctgtcattgcacatactggctcactcagtgtctttcctgctgctgatgtggctctgtgctggcagtttcagggtcagtgtgctgctttcctagggacattagaagggcgcaggagtgcatgtctgcccattcctttggagtatcgcagatgatgctatacgataccaagtgttaccgctcacagagactgggaaagggaaatgggagtaaccgaaagccagatggaacgaaagcaaacatggaaaccatgatcacggcaaagagccatccttgtatttaagaagtaactttggccaggtgtgatggctcacgccgtaaccccagcactttgggagaccaaggagggtggatcacgaggtcaggagatcaagaccatcctggctaacactgtgaaatgctgtctctactaaaaatacaaaaaattagccaggcgtggtggtgggcacctgtagtcccagctactcgggaggctgaggcaggagaatggcatgaacctgggaggtggagcttgcagtgagccgagattgtgccactgcgctcgagcctgggcaacagagcgagactccatctcaaaaaaaaaaaaaagtaactttatgaaatgccacagcattcagtgtggcattaagttacaacgaccacatagagtaccaaagtgcttcaggttatattttaagttgtggtgcagactgagggggcttattcaaaatgaaaatactaacttaaatggccaccaagttcaataaacaaagatgtcaaaatactctcagaaatacaactgatactatctttaaaagacgtaataaaatcatgtgaaaaactgt

SEQ ID NO: 1204 - DNA, 833 bp, Homo sapiens
  ENST00000423585
gccgggcatggggcgcgcggcagccgcctgaagccccggcctggcccggccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacgaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctc

SEQ ID NO: 1205 - DNA, 730 bp, Homo sapiens
  ENST00000582723
gccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacgctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcgg

SEQ ID NO: 1206 - DNA, 559 bp, Homo sapiens
  ENST00000578882
atgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccagggtcatgggaggcaccgagttcgtgttcaaagtgaatcacatgaaggtcacccccatggatgcggccacagcctcactgctcaacgtcttcaacgggaatgagtgc

SEQ ID NO: 1207 - DNA, 2218 bp, Homo sapiens
  ENST00000584596
ggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagtgtgcagcggagtcttcaggaagttttcagatccttccccaggacagctctgagaaggaacaaaatggactcagccattggtgtctttccagacccgggcaccagaaagactgggcactgtgtgcccacgcgggcccagccacagcaggttgtccgagctgtctgtggccgccagcggagacaggaagaaaggctgggagaacgtcttcaaagaccgtacacgcctgcccaggagaggctggaacctcctcctttgaactcttctacttccctaattgctggtccatagagaccaagctgaaaattagtttaaatgctaaattgagtttcaaaccacgagcctcagcccctctagaaacaggacaccgtgtaaaaatagaaactttaagtcaacttgtttttctaagctttatacagctttgctgtgaggtccagagtcctttggcaaataagtgacgtttgaagagattcaggtgtgctgggagggttcattcaggatggaactggctactcttcattataaaaaagtcaagacagcgtaaagtaaccctgaaagaagatgctttgcctgaatcaagtttagcgtcagagcagccataatcctctgccgagattcttcagaactatgcagttggaggggtagaagccaggctcattctttcagggatggaatcaaatggtaattaaaagcaaatgattgccaaggtcgttagagatgccagagcctcaggatcagactcgtaagcaaatggaattggtctttctccaaaatcctgcactgatttaaccacaggatcgtaaatcaaaggggctgtctgaaaaccagacagccttccccaggctgtgcatctgaaatactcgatcccagcacatgtacagcaggggagctacacacgggagggagaaaagcaccgggctttgggagtacctgagaactgcagaaaaagagcatgctgtgctttctctctcaaattctttaggagccgctaggctggagccagcatatgtttttgaggtagcttgcctctcagaggctttttagaggatgtgtgacctgtgcagcttcctgatgtcagtgacaccatggggatgttgagtcaggtggtcttggagcctggacttttcagcctagctgcaggagccagcatggagggacgtctcctgagcatgtgcttggtgtggctcctgggtgggtgggcggctgcgtctctggggtatagaaggagccaggtgcttgtggaagaattccataccacttttctttctgctagtgtggatttgcagaggtgatgggagatggacgaggtggtggacaaccagaagttcaagaagtcatgacctaagacagtttcaagaactagtcttacaggaaggagaaccctagaagaaaactgtgactgctccctggagccaggtgtttcctataaggcagcaaatgttgcacaattctatgaaaaaacagagctggcaattgggataggttgagggggtcttgaccctgaaggggttgcttttgtggaccttttatctgggccgaggtgtgcagtgtcacaatcactgggctacaaggctgctgatagacacttctattgcagaaacagctcattatatttcttgactccagagtatttcagcagataaacaggcatgcaaggttgctttatttaaggagttaggggaccaggaaatatttgttgtcagggacaatgcaagtggtaaatattttatcccttaaaaggcaagaaagctcagaggacatgaggaaaccctgcaaaagcaggaaattggccatttaaaaagtacgcatgaggtccctactccagggagtgtttgctgagccccaggggagaaaggaagaggatgggccagccaggagtgcccagtggatttacagcagatttaataagtctactttaattatttaaatgaatcaaaatgcataggagtggaagaaagaaacaagtaaaaagaaataaaaattcttttcggaaa

SEQ ID NO: 1208 - DNA, 744 bp, Homo sapiens
  ENST00000579685
ccagaggatgttctaccggccctccagttaccagccccctctgcagaatgccaagtggagatggggtttcaccatgttggccaggatggtctccaactcccgacctccagtgatccgcccgccttggcctcccaaagtgctgggattacaggcgtgagccaccgtccgcccggccgccatctttcaaatgatctcagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtc

SEQ ID NO: 1209 - DNA, 3245 bp, Homo sapiens
  ENST00000374987
ctgaacaggaagcagttcgctcgcgcctaggttggcgcgggctgggaggtgttccagccctttaagatgttgcgcgtggtgagctggaacatcaatgggattcggagacccctgcaaggggtggcaaatcaggaacccagcaactgtgccgccgtggccgtggggcgcattttggacgagctggatgcggatatcgtctgtctccaggaaaccaaagtgaccagggatgcactgacagagcccctggctatcgttgagggttataactcctatttcagcttcagccgcaaccgtagcggctattctggtgtagccaccttctgtaaggacaatgctaccccagtggctgctgaagaaggcctgagtggcctgtttgccacccagaatggggatgttggttgctatggaaacatggatgagtttacccaagaggaactccgggctctggatagtgagggcagggccctcctcacacagcataagatccgcacatgggaaggtaaggagaagaccttgaccctaatcaacgtgtactgcccccatgcggaccctgggaggcctgagcggctagtctttaagatgcgcttctatcgtttgctgcaaatccgagcagaagccctcctggcggcaggcagccatgtgatcattctgggtgacctgaatacagcccaccgccccattgaccactgggatgcagtcaacctggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttcagggttgcactttggacattgtggaggtactccataaagttgagtcagagaagctatctcaatacttggtttgccggctggctgtagcccaatgatgtaattcccagagaaaggggaggagggaggggggaggagggaatagtgaggcgtgagcagcagtgctcaccataaagggttctctgctcagttgtaggaatttcctgtacggctaaggtgaaatcagcaaggaaggtgggctgtgtagccttaaaccagagctttccagctagtgcgtcccacagctgccacagtgggttacagggttgaaagaaacggtcctcagccctcagagttgccaggcagggcctgggaccacacaagtttcagggacgattgcctccttagcaagtagtatcattagtacccctaagtgtgccatggaaatgtttcctgtatactgtgacctggaaagtgggagcattgctttgaacacagtgcttgctctagccaagcctcttctcacctttgaaaatgggactggtagaccaggcacagtggtgcacgcctgtaatcccagcactttgggaggctgagatgggtggatcacctgaggtcaggagttcgcaaccagcctaacatggtgagaccccgtctctactaaatacaaaaaaattaactgggcgtggtggcgcgtgcctgtaatccaagctacttaggaggctgagacaggagaatagcttgtacctgggaggcggaggttgcagtgggctgagatcatgcattgcactccagcctgggcaacaagagtgaaattcagtctccaaaaaaaaaaaaagaaaagaaaaagaatgggactggtaaatcctgttctgtgggatgccgtgggagggagagaggataatggattgaggaagacatccatatccccttatggaaaatacctctttggttttggggaaccactcctttctagggaatttggttagggctgactcatttcctggcttcaggggctaccctgggcccagatttccagggcccggattaccagtgaagcgtcaatccctggatttttattgaaaccattggagaagagccatctcaaataaatctgccaagtatcctagctctttgcaactcactgtgtagtttttgggcatttccttcctctttctcattctgtttccctgttggtaaaatggaatggtgaccaacaagtgacctatggttacctcatagatctgccacttgtctgagggagtcagaatgcacttgtctgttccctgtccaataaaaggcttcacatgc

SEQ ID NO: 1210 - DNA, 728 bp, Homo sapiens
  ENST00000471758
gcgggctgggaggtgttccagccctttaagatgttgcgcgtggtgagctggaacatcaatgggattcggagacccctgcaaggggtggcaaatcaggaacccagcaactgtgccgccgtggccgtggggcgcattttggacgagctggatgcggatatcgtctgtctccaggaaaccaaagtgaccagggatgcactgacagagcccctggctatcgttgagggttataactcctatttcagcttcagccgcaaccgtagcggctattctgcacatgggaaggtaaggagaagaccttgaccctaatcaacgtgtactgcccccatgcggaccctgggaggcctgagcggctagtctttaagatgcgcttctatcgtttgctgcaaatccgagcagaagccctcctggcggcaggcagccatgtgatcattctgggtgacctgaatacagcccaccgccccattgaccactgggatgcagtcaacctggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctct

SEQ ID NO: 1211 - DNA, 758 bp, Homo sapiens
  ENST00000560890
agtcctgctaattccctgaatcaggccactgccatctcatgcctgcgttgcactgaggacctccagtctggaagctcattttccatatctttacaaagcagatctatcactctgaactgttgtctcgacccgagttttgatagagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgct

SEQ ID NO: 1212 - DNA, 456 bp, Homo sapiens
  ENST00000559744
tgaatcaggccactgccatctcatgcctgcgttgcactgaggacctccagtctggaagctcattttccatatctttacaaagcagatctatcactctgaactgttgtctcgacccgagttttgataggtattgtgctgggatctgaccattcaaaatacaatcactggaatctgaagaagtattctgtgggagtgaatggaaatatatatgacttttaaatgggcaaagatattagtgaacttctaggtgctgaggaaacaacaaagagcaaagcaaagtccctgtcccccaggagttcgcgttttaacggggaagaaaaataagcaagtgaaatggacgactgtgagaagacggagcagggagatgttactattgcttgtagggtggtcacagaatgcctgcaaaaacaacccttttgaagaattgggaaaaaaataaaaaccatttggctgaaa

SEQ ID NO: 1213 - DNA, 4189 bp, Homo sapiens
  ENST00000261879
accgaaccccgcccgcgccgggagcatctcgcgtccccaacgggcccccgggtcggtttccgcggtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattcacttggctttcacacaactgctctccgaaaggggtgctcagtggtgtgcgtcctggctgcacgagaatcacctgggacagtgtaaagccgactgattctgggctccaccttccagagctaattggcctgggcacgtggtgagttttaaaagcttcccaggtgattctgatgtgcagccatgttgagacccactggtttggtatccaaataggagcttcctgagaacaccttaagtggatgagaatctggtctttagctgtctcctaactcaactcgtgctgagcaagtaagtatctgaatgtcaaatcctggttatcttttatcttcctaagttctgaagtcacaaaaggctaaagggctatcacccctgctcactgtttgcgtgtacttcaccatcttaggagaacacggtaggttgggcttctaaatgcaataataaattacgctgactgtggtaacttagccaaagtaagatactgattaagccgtatttttctgaagtgcttccattccaggttttgctttctgaggcattacattgtttttgagtatagattacattttattaactaaaaatgattgttttgtgacttccttgggaaggtattttaaaatcaggaatttttatgcaatgtctataagcctgtttaaagctttccatgggctctgccccaaggccgttggctgcagcgttcaccatctgagtgccagttgctggactagttgaggtgaagtgcattgttttctctctgagcagctgtgcggggagctgagtgatgtgccctgggacaggcttcactggagctggtggaagtataaccagaagcacaaggaaatgagccaaaagggtgtcattgacacttttcatttgctcctgtgatactaacaacactttcacccaaatggcttaatgtaatattggaaatagatcttaaactgccaaatctcacactattgcataatccatatgctctttagatctagtcagtgtctctgggttttggtagcagatacagcgttccctttacaggaatacccaaggtgttctttcagcttccagacaggtcctttgatttcctttataaagggaaaattctggcaaatcgtgcctttactattagaaattgttcccagttgatgtcttttggggagctggtggcatgaaatgcaaatgacctatacattaaagtgatgtctcagtgaataccatacatgcagtagaacattcagaagagaggagcagcaatcctgaggggctgggggagtgacagtggcaggacggatgggcgggtttgacagattgtggtgggaagaagaatgatcatgtttaaagctaacatagccagtgttttgggctagccacacatcattccagagaccaaaaccttactcatgaactagacctttatcgatatcagtgaacccccatgtttaaaatattagaatgtttagagataaaatagagataatagagataaaagaagaggagggcttctatcaatgctgtaaacagtctgataagcgactgtggttattcccctaaagtttacttcagcactaacactagtgcttccgctggagtttgcagttttccagctttatacaggattttcctttgactggaagagtcaaggatatagagactcaacagtgacatttattgtacaacatcaaggggaataggatactcatcaaactgggattattcttatcaaaacatggtcttctttgaataagaaaaatacatagttggttattatggacttaaaactgtgttaaatggatattctgataaaatatttgctgctctgtagagtgtggaaagtctgagaatattagctttactcatcttgagctttgaggatgttctctgtacgccgatggtttcatattaactaaaaaagctgggtattgtaaaatctcatttataaaaactcagatgagaagaaaattttctttgatggtgagactgttgtcttagttcaggaaattatttaataatcctttgttacctgtgaatgaaggaactttgtaattctgatttatcgtaaaacatgagcctttccagagtcagcttagacactgttgtcgcaaatagccatgctttgccttatgccaaggaggcccagagggagggcctagtcttcctctgttgctgtacatatattgaaatgcttttttttttttattttgcatttgttatctataatgagctttctgagccctgatattatgtgagacaaacaggagttattgatgttatacactcccttccattcaggattttctgcttggagggaaatatgttgaccttagagaattgtgaatattgttgcaattcttgaatatattaccatgtgaataatagagactgtgttgctctctagtataagctatatttatttttgattcatttgaattactagttataactggagaaattttgttacctctatcctggcttgcctgactggctgtataatagcagcagcctcttttagagcatcttaatgaaaacatggatgaaaggaattaatgatgatatctgcagactgcgtagaaaatggcttttgttcccagcgttaacattttcttctcaatcacatttcaatgtttgtggagagtggcagattcacaccagaaacactaggtgttcatatccatagcatggatgcagaataagcagttgggagagaagcttcttcctacctggtactcctcccattcacctcagcccagccccagacaggcgttagcattcagtgtgggccctcaggcagccctgaagcctggctgggtcatcagatgggggcagcctgtgacgggcaccagcggcctgattccagggaagagttcctggagggtgttggctgtttttgttagctcagtttttttctgggctccaccattcctaactccaggtagacaagatagatgtcacacacaacaattttaaagtattttgcttagtgcattttgtttatgattgcagtgtttgtttcttatttaataggctttttacttcattctattaaattttagtgtttagaagaggcgggtactgtcactgtgtaaaatatgtaatattttatatgttataccatgtcatatatacttgcaatatcagaccttgcattcaatatacaatgcaattgactctttgcagacctgcatttttcagtgaacaataaaaagattgtctggcactcctca

SEQ ID NO: 1214 - DNA, 685 bp, Homo sapiens
  ENST00000380343
tttccgcggtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttc

SEQ ID NO: 1215 - DNA, 872 bp, Homo sapiens
  ENST00000380340
tttccgcggtggccatgactgcggccgtgttcttcggctgcgccttcattgccttcgggcctgcgctcgccctttatgtcttcaccatcgccaccgagccgttgcgtatcatcttcctcatcgccggccgaagggtggaaacctgtaaaaacaccgaagcacctgactgtgcgtctccttctgggagcttgagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttc

SEQ ID NO: 1216 - DNA, 672 bp, Homo sapiens
  ENST00000560353
gtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttc

SEQ ID NO: 1217 - DNA, 1455 bp, Homo sapiens
  ENST00000559971
ctttatgtcttcaccatcgccaccgagccgttgcgtatcatcttcctcatcgccgggtgaggcggtcgcgtcgggaaacccggacgccggggctcccctcccccgctggggttacccgcgaccctcggcgcccccaccgcgcggctcgaccttgttgcgtttcagacgggaggagggttgagagggggagagcggagatccggctccccaaaggcgcctcgccctcttaggaagaagcgcacactggggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattcacttggctttcacacaactgctctccgaaaggggtgctcagtggtgtgcgtcctggctgcacgagaatcacctgggacagtgtaaagccgactgattctgggctccaccttccagagctaattggcctgggcacgtggtgagttttaaaagcttcccaggtgattctgatgtgcagccatgttgagacccactggtttggtatccaaataggagcttcctgagaacaccttaagtggatgagaatctggtctttagctgtctcctaactcaactcgtgctgagcaagtaagtatctgaatgtcaaatcctggttatcttttatcttcctaagttctgaagtcacaaaaggctaaagggctatcacccctgctcactgtttgcgtgtacttcaccatcttaggagaacacggta

SEQ ID NO: 1218 - DNA, 515 bp, Homo sapiens
  ENST00000558631
cccttttctcccctttttcattactctgctgcattctgccattcatttcctttcctcttcccgcttccctctctgattcatcatttagccaagcacatgcctctccagagccagctgtccactgcttcaggaagaacataagcaccctttcccctccaacacactttgtattaactagtccttggaaatttgacttgaaatcttggcaggaaaagagttaacagtgtttttcttcctgtttagtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccaggtgagtgttgccgccatgctc

SEQ ID NO: 1219 - DNA, 376 bp, Homo sapiens
  ENST00000559823
ctgccattcatttcctttcctcttcccgcttccctctctgattcatcatttagccaagcacatgcctctccagagccagctgtccactgcttcaggaagaacataagcaccctttcccctccaacacactttgtattaactagtccttggaaatttgacttgaaatcttggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttcca

SEQ ID NO: 1220 - DNA, 731 bp, Homo sapiens
  ENST00000560716
ctgtaataagtctcatggtggctggaatgttcttttctaccctttgactttgagctcagtcatgtggcttgaattggccaattagtggttatgatgtaagttagaggcttaaaaagtatttgcatgattggaccttccttcttggactctggtgccatgagaagaagataccttgggaagttaatggccacttagcctggacccttgaatgaatatacccagagccacacagagcccaccccaggagcttgcagcagagttttccagctgatcccagcctttatcagcaatgcacagtcagcctttagacctctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgc

SEQ ID NO: 1221 - DNA, 1726 bp, Homo sapiens
  ENST00000257254
ggggtaaggcaagagagggtggaggaaattctgcaggagacaggcttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaatcctcgggggccctcatccctgccatctacatgttggtcttcctcctgggcaccacgggcaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccaggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcagagtcacctcctctgcccagagctgtcctcaaagcatccagtgaacactggaagaggcttctagaagggaagaaattgtccctctgaggccgccgtgggtgacctgcagagacttcctgcctggaactcatctgtgaactgggacagaagcagaggaggctgcctgctgtgatacccccttacctcccccagtgccttcttcagaatatctgcactgtcttctgatcctgttagtcactgtggttcatcaaataaaactgtttgtgcaactgttgtgtccaaa

SEQ ID NO: 1222 - DNA, 3609 bp, Homo sapiens
  ENST00000606794
aggagacaggcttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaatcctcgggggccctcatccctgccatctacatgttggtcttcctcctgggcaccacgggcaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccaggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcaggtagtgtggctactccttgtcctatgcacatcctttaactgtcccctgattctgccccgccctgtcctcctctactgctttattctttctcagaggtttgtggtttaggggaaagagactgggctctacagacctgaccctgcacaagccatttaatctcactcagcctcagtttctccattggtatgaaatgggggaaagtcatattgatcctaaaatgttgaagcctgagtctggacgcagtaaaagcttgtttccctctgctgctttcttagatctgcaatcgtctttcctcccttctttccttgtagtttttcccccaccactctctgcagctgccgctccttatccctgccttctggcaccaatcccctcctacagctcgtccccctccctccatccatccttctcccctgtctactttcttgttctgaagggctactaagggttaaggatcccaaagcttgcagagactgaccctgtttaagctttctatcctgttttctgagtgtgaggcagggaatgggctggggccgggggtgggctgtgtgtcagcagataattagtgctccagcccttagatctgggagctccagagcttgccctaaaattggatcacttccctgtcattttgggcattggggctagtgtgattcctgcagttcccccatggcaccatgacactgactagatatgctttctccaaattgtccgcagaccctttcatccttcctctattttctatgagaattggaaggcagcagggctgatgaatggatgtactccttggtttcattatgtgagtggggagttgggaagggcaactagagagagaggatggaggggtgtctgcatttagtccagacactgcttggctcgctccccgagtcctcctgtttctgacttcctgcataactgtgagctgaagggtttcctcatctccccatcttaccccatcatactgatttctttcttgggcactggtgctacttggtgccaagaatcatgttgtttgggatggagatgcctgcctcttgtctgtgtgtgttgtacttatatgtctatatggatgagcctggcatgaacagcagtgtgcctgggtcatttggacaaacctcctcccaccccccaatccactgcaactctgctgttcacacattacccttggcagggggtggtggggggcagggacacactgaggcaatgaaaaatgtagaataaaaatgagtccaccccctactggatttgggggctccaacggctggtccgtgctttaggagcgaagttaatgtttgcaccaggcttcctgtagggagatccctccccaaagcagctggcgccaaggcttgggggcgtcctactgagctgggttcctgctccttcttgggctccatgaaggaagtaagaggctagttgagagcctcccttggcccctttccggtgcctccccgcctggcttcaaatttatgagcattgccctcatcgtcctttcttgttccagggtcagtggccctcttcctaaggaggcctcctgcttgccatgggccaaaaggcacggggtgggttttttctctccctaccctcaggattggacctcttggcttctgctggattggggatctgggaatagggactggagcaagtgtgcagatagcatgatgtctacactgccagagagaccgtgaggatgaaattaatagtggggcctttgtgagctagaggctgggagtgtctattccgggttttgttcttggaggactatgaaagtgaaggacaagacatgagcgatggagataagaaaagcccagcttgatgtgaatggacatcttgaccctccctggaatgacgccagctctgggggcagagggaggaggagaggggaaggggctcctcacagcctagtctccccatcttaagatagcatctttcacagagtcacctcctctgcccagagctgtcctcaaagcatccagtgaacactggaagaggcttctagaagggaagaaattgtccctctgaggccgccgtgggtgacctgcagagacttcctgcctggaactcatctgtgaactgggacagaagcagaggaggctgcctgctgtgatacccccttacctcccccagtgccttcttcagaatatctgcactgtcttctgatcctgttagtcactgtggttcatcaaataaaactgtttgtgc

SEQ ID NO: 1223 - DNA, 1789 bp, Homo sapiens
  ENST00000611099
ggaggtgggaggagggagtgacgagtcaaggaggagacagggacgcaggagggtgcaaggaagtgtcttaactgagacgggggtaaggcaagagagggtggaggaaattctgcaggagacaggcttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaatcctcgggggccctcatccctgccatctacatgttggtcttcctcctgggcaccacgggcaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccaggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcagagtcacctcctctgcccagagctgtcctcaaagcatccagtgaacactggaagaggcttctagaagggaagaaattgtccctctgaggccgccgtgggtgacctgcagagacttcctgcctggaactcatctgtgaactgggacagaagcagaggaggctgcctgctgtgatacccccttacctcccccagtgccttcttcagaatatctgcactgtcttctgatcctgttagtcactgtggttcatcaaataaaactgtttgtgc

SEQ ID NO: 1224 - DNA, 2266 bp, Homo sapiens
  ENST00000537454
aatcctgaggtgctgcatccacagtgggcatggtgctggtgcctgcttggatgatccttaaagaaaggtcctgggggctttggttcatggatccttgagctaggagttaaaggtccaggcccctgggacccttgggaagcagagcaagaagagtgaactcctgggtctgaaggagaatgggctgggggcttggtctctggtcctgagagagaaggtgcccagacttctggatctgaaagaggaagggactaggtctcaactgctgccttcttgactggggacattttggaggcctgtattcctgagccctcaacagaggaatgtactaggggatgggggtctctgatgcttgcatccttggaaaaggacaaaactgccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagca

SEQ ID NO: 1225 - DNA, 2495 bp, Homo sapiens
  ENST00000221891
actctgcgcgaagccgccacgctattgtcctgaccaggaaggcggggccggcgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgcagacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccct

SEQ ID NO: 1226 - DNA, 2295 bp, Homo sapiens
  ENST00000590561
gctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgcagacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccct

SEQ ID NO: 1227 - DNA, 2052 bp, Homo sapiens
  ENST00000586861
atagcaacgggagcgctggggcgcccccgccctacgggagctgtttcccagggaacggtgcctccatggaggcggtgtgcggtgcttgggggagggggctggtgctgggggtctcggtcctagggagcaaagaaccaggggaccctcatgccaacgccccccgagccctcactgtcctttccacttccatccaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggag

SEQ ID NO: 1228 - DNA, 586 bp, Homo sapiens
  ENST00000589743
aaatttataacgggaagggagagttttggagaggcggaatagaggaaaaggcggggcctaaaggaggatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtc

SEQ ID NO: 1229 - DNA, 1324 bp, Homo sapiens
  ENST00000592316
ctagggaagcgatgtcctcatgaatactagagccttgaaaacggacctggccgggcgcggtggctcacgcctgtaatcgcagcacttggggaggccgaggcaggcggatcacctgaggtcagaagttcgagaccagcctggccaacacggcgaaactccgtctctactaaaaatacaaaaattagcctggcatggtggtgcgtgcctgtaatcccagctactcaggaggctgagacaggagaatcgcttgaacctgggaggaggaggttgcagtgagccgagattgtaccattccactccagcctgggcgacaagagcaaatctccgtctcaaagaaagaaagaaagagggagaaagaaagagaaaagggacctgactactggagaggggtggctggcaggggcggggcagtgggctgattgcccccatctgatccccccagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgcc

SEQ ID NO: 1230 - DNA, 664 bp, Homo sapiens
  ENST00000588808
gtgaatgggccatggcagacaaccagtccaagaacctgcctaaagccgacagacaggccctgaatgaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcg

SEQ ID NO: 1231 - DNA, 547 bp, Homo sapiens
  ENST00000589298
cacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagcctgggtgacagagtgagactctgtct

SEQ ID NO: 1232 - DNA, 1179 bp, Homo sapiens
  ENST00000587274
tccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcat

SEQ ID NO: 1233 - DNA, 310 bp, Homo sapiens
  ENST00000590926
gacagagtgagactctgtctaaagaaaaaaaaaaagaatgagatcagacttgggggtagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctac

SEQ ID NO: 1234 - DNA, 463 bp, Homo sapiens
  ENST00000591165
atggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctacc

SEQ ID NO: 1235 - DNA, 1130 bp, Homo sapiens
  ENST00000343267
tctctctcgcacacatacccacacacacacacacacacacacacgcgcgcgcgaaaacaatatctcatttcttcttcagggagcagctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccccccccataaagacaaaccaatcaaccacgacaaaggaagttgacctgaacatgtaaccatgccctaccctgttaccttgctagctgcaaaataaacttgttgctgacctgctgtgctcgcagtagattccaagtt

SEQ ID NO: 1236 - DNA, 950 bp, Homo sapiens
  ENST00000458447
agaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagacggagtctcactttgtcacccagggtggagtgcagcatcaccatcttggctcactgcaacctccgcctcccgggttcaagcaattctcctgcctcagcctcccaagtagctgggactacagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccccccccataaagacaaaccaatcaaccacgacaaaggaagttgacctgaacatgtaaccatgccctaccctgttaccttgctagc

SEQ ID NO: 1237 - DNA, 782 bp, Homo sapiens
  ENST00000421243
aagacaggcatctcaaatcggctgattctgcatctggaaactgccttcatcttgaaagaaaagatggagtttttgctctgttgcccaagctagagtgcaatggtgtgatcttggcttactgcaacctctgcctcccatgttcaagcaattatcctgcatcagcctcccgagtagctgtgattacagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagc

SEQ ID NO: 1238 - DNA, 681 bp, Homo sapiens
  ENST00000453131
aagacaggcatctcaaatcggctgattctgcatctggaaactgccttcatcttgaaagaaaagtttaccaggaagtaacccgggcaaattcacctcgttggtatgaagagagtgtcagcagaggtcgcctccagaggaggtgctgtggagactgagcgcatagcacccttaaaatcctgggaccagggcttctccacggctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttgg

SEQ ID NO: 1239 - DNA, 1210 bp, Homo sapiens
  ENST00000463719
gactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtgtaagtatccacttttcccaggaggattcagggacaggaaatatgcaaactgaaggctagcgccccggcttggagaattcctgagacacctgagtgtcatctataatcactcagcacataattatctgtcaaacacttactacatgtcacgcactagggttgccatgatgagccggacagagctggccttggtacttatggagctcacatcccagtgtggatactgacacgtgaccccgcaatttactataactagctagcgtttcaacaggtgaaacacaagtaggtgcacaccgggtgtgggctgcagaagacacaacccagtcttgtttcccaaaggaaactggggcccgaaacattagcagatattagcagaacaacctgcacggcgcagaaactaggaagcaagagatgacaagagtgacggcaagtttgaatcctgcttctgccactttccagtcacattgttggggatcctgtgagatacctaatgacaggcatttgcctctgggttctgagctaactgaggaagggacacaggcaatagagaaagcaccaaatattagttttatttccgacgaagatacactagagagttcaacccagaactgtgaggctttctaacacgaagagtgcttgaaagcccctttcccacctgcagggtagacactgaagtcatcagctac

SEQ ID NO: 1240 - DNA, 3239 bp, Homo sapiens
  ENST00000258530
tttccctgccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgcttccagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcccattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcataattggacctaatagcatttctttgtgcagttaggtgatgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaaatattctgtttctttc

SEQ ID NO: 1241 - DNA, 3196 bp, Homo sapiens
  ENST00000547439
cggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgcttccagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcccattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcataattggacctaatagcatttctttgtgcagttaggtgatgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaaatattctgtttcttt

SEQ ID NO: 1242 - DNA, 2680 bp, Homo sapiens
  ENST00000539978
tctattcatggactcctttttagtttgcagtgctgcacgatgcattgtaaaactagtctgtgtgcatacacatgcgttatttctgcttacctctcatatgtgggaagctgaacattttagggattaagaaatctgcctccattgttgtttagaagcctctgctccttgcctggcactactggctgttgggaatgtgaagataaataagagtgactacccttgactggttcacagtttgttccagagacagataatgaggcaacagttccagtacagtgtgaatcctgctgcgataggaacacaaatgcagctttgagctcctgcagcttgtacttcttcaggggcttattctcttgtcctactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgcttccagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcccattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacac

SEQ ID NO: 1243 - DNA, 851 bp, Homo sapiens
  ENST00000547790
gagctttagctacacaggttccttaaaggcagaaagcaggacacgtggtcacacacagctatctcgcctcaccctctaacaggctttatctctatttcggggaatttgtatttattctggacttctacaaactcttctaggaatattaaatttatccaacatttgtgacataatgtatcttttaaaatttcaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgt

SEQ ID NO: 1244 - DNA, 684 bp, Homo sapiens
  ENST00000546731
aaatacatttaagagagagaagaaaaattcctattaagaacttttaacactggaattacctgagtttcacttacctggaatattttttgtgtggcataaattggcaacagaggtcaggacagttggacgcaaatgccccgggccctatgtgatgagtctcctgcagccaggtcctgtgttcccaagtgggaacagtgagaacagtgacctcactgtactcccaaatcacatttgttctaaaattttatccttctctacttttgccaatcactacttttcttgtcttttgcagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttagg

SEQ ID NO: 1245 - DNA, 2190 bp, Homo sapiens
  ENST00000551662
agtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgatgtctgtttatttttagagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgcttccagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcccattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgac

SEQ ID NO: 1246 - DNA, 564 bp, Homo sapiens
  ENST00000553109
gatattgtgcttcctgctacagaattccttgatcagaacagagggagcaggcgtaccaacccttttggtgaaactgaggatgaatcatttccagaagcagaagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacat

SEQ ID NO: 1247 - DNA, 428 bp, Homo sapiens
  ENST00000548425
agattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaaggtctctttttcatgtgaagatcccataatatcccagtccaaacaagtccattttaaaagagttttctggcatt

SEQ ID NO: 1248 - DNA, 1797 bp, Homo sapiens
  ENST00000547809
gaacacaaatgcagctttgagctcctgcagcttgtacttcttcaggggcttattctcttgtcctactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgcttccagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcccattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaatgtaagtaccgcatacaggttcatgttagtgattactccttaattcacctttgtatctaccttaaacacagcctaggcactttattaataaagatctgccactaataggactaatag

SEQ ID NO: 1249 - DNA, 372 bp, Homo sapiens
  ENST00000552945
aaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcagttcaagtgttaagtgcccttctagctgcagctgtcgtgtttgttcaactctggctattcccctaggcgtaccaacccttttggtgaaactgaggatgaatcatttccagaagcagaagattctcttttgcagcagatgtttatagttcggtttttgggatcaatggcagttaaaacagacagcactactga

SEQ ID NO: 1250 - DNA, 555 bp, Homo sapiens
  ENST00000549573
ctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacccaggggagccgtggctggaggtttgatccaggacctggacaactgctcagtgatggccgtggattgcgaagaccggcgctactgcttccagatcaccacgcccaatggaaaatcg

SEQ ID NO: 1251 - DNA, 547 bp, Homo sapiens
  ENST00000549974
aatggttctacctatcatacaattccgagaaaaggatctcacagaagtaagcactttaaaggatctatttggactcgctagcaatgcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaagtgagaacgccaccgtctgcctctttttctgaaatccgttt

SEQ ID NO: 1252 - DNA, 529 bp, Homo sapiens
  ENST00000550648
gaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaaggtaatgctgcactccggccgggtcttgtgtgccccttgcctttcatgctgatctgacatctctgggaggtcacggggagggttctaactgtggagggtcgcacagagcctctgtccaccccagaaatgctcgctaacagtgcccttgccttagctgccaatattcataaatatctggggcacattggcagagttttctccagatctcttgttgtgaatattggagtttcacatgtcacaagcctgggaacccagcttagctttgctgtggttttagaaga

SEQ ID NO: 1253 - DNA, 637 bp, Homo sapiens
  ENST00000546768
ctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacaggtaggggagtccctccctgagggctgaaacctaagctagctgtggcgttctgctgagagggcacgcaggagacactgaagcatcgtcgtagaaagaaacataaatgcacaatctccctggctactttgtgggattcagcacttggacagcttccagttgagctgggtcatcttcagctggacatgcattggcctcaagttaggccatatgt

SEQ ID NO: 1254 - DNA, 514 bp, Homo sapiens
  ENST00000553097
agagccggggagtgctctcggccgccgcgtctcctgccctctgtccttccaacccagccctcggctgagccgcgccgcaccatgcccgccgtggacaagctcctgctagaggaggcgttgcaggacagcccccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcct

SEQ ID NO: 1255 - DNA, 493 bp, Homo sapiens
  ENST00000549056
gttgcagtgagccgagatcgcaccattgcactccagcctgggcaacaagagcgaaactccatctcaaaaaaagaaagaaagaaagaaaaagaaacaaggaaatcgtagtaccataagaggaaagaatgacacactcctacactcctgcaagacatccaagattacaaaaaaccagactgctggttcctgctgggatgatcacactacagctgtgctagatgaccacaccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaa

SEQ ID NO: 1256 - DNA, 5274 bp, Homo sapiens
  ENST00000383168
cacatggtgcagaatctttccacccctaacactccaaaaacccaatcagacaagtggccgtaatctgactcccagcacacagggagctgcggggcaggcaatgagagctgcactctggctggggaaggcatgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttattctattaaactgagtttaacaatggcaaaatacagtatgtcacagtcatgcacattcaagagagaaaatataacaagttcttttatgagcaatcccttatgcatagactaccttggcaaaagagcattagcaagtgtcactgctcatcagttacttccttccatttatatcacaaatacccaagtttcaattctaacttcatttcatggtatttcttcctcctcaatgcccaaggtaatgtgggactaaagcccagaaatttgaaaagaatattcagaaatccttcccaaatcataagggcacctattgagattcaagacaagcagactcgtaaaatcttgtagaggcagaggcaaagttatcatcatacaaaaatcacaaacaaaaaggagatctgtattcgggtatcaaacggttgatctgttttcagtgcacaccctcaaatgcaccacaccagttttacgatctaagcttttaacccctttaccactttgcttatttttaaaaaatttattggcaaaactggggattttgtttgtaactttggttatctatatttaaacattagctgagacatatttttgataacaagaacttagctagttgagtcctggctttttgttgattattaagctgtgttcactctagaaggtgtaaaggccctgtcccaatctctgctctctcacttctcgtgacatttgttgataatctttactgcaagtgtaatgatatttgagtgaattaaaatgcatgacagacaaggtacaacatggttgcagaataaaagggtgaggacatcagatcactctgtattcaaagcttactagacgaacaatctttcatttctggatatattgtagctaacccaacacatttttaaactatttttgttactgactcacttacttgtcaaaataattggtttttctgtcctgctttgccttttgtcactagaatgttctccagaaaccccagtttctgtcatcttaactgtctagtctagccgttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgtctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacaccacacactgcgccagtgacacatagttacttcctggctgggacggcacctatagaaactagggtacaaatctcccaaagatggtttgcaccgtcatttcaaatgtttgcacaatataccacttagaggcttaaaatcagggtggttcagttcaaaaggtaatatcaaccgtcagcaaacatgtcagtttaaaaataagttcggttaacaaggaagtgttaagcagattttttgaatacacttacaatatactggcttataatcatttttattctgccatatggtttatttcatatacactcacttttacactcacttccaattatagcattcaataagttacggttaaagaaaagtgaatggtgtttttgtaatttgttttctagtagctagcagagagcctggcacatagtatgtattcaaaacaagtgtgttaattaataaaaatatataaatctcatttgagatttaagaatataaataattttcttttaatctttattttgctcaatatttaataggaagtatgatttcaaggactactaaaggaaggcaatatacatgtgaaaaccataaaatacattttttgcattctactatttttaggggcatgaaatgaatgaaagctttagcacttttttgcccctacatatgagacaacatattttgtatttcactcaaggctctgccagtaaaaagtaatgaaattgtacctttctaatgacatctatgcagcaggggtctatcgccttgtggatggcaccaaattatccaagtgtattaggagactggggcttttttctttaatcccttcttattaatgaagtgcatagtgctgctcccaggagaccactgctgacagatacacagagaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtcaaaagtgtacaaaagggaaagagtcttattttaagctttcaggctttcttaaaaacttggggaccagaatttcaatgtatgtttccattgttgaagataacattttcttcaaagagccttaaccttttgtactggaaggaaatattttctggacttaagtagttgcctaaatttaagattcctacactttatttctgccattgatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaaattccaaactagagcagtaaattcaaatggtaagatgaatcctagaaggcctctgattgcagcatgttgacaccaacctcacgttacgaacaattcacagagaatttgcctttgtggcaactgaagatggaagtctggggggcacagacaaccttatcaaacaatataaaagccaatataaattctcataagcactatagaatttgcaaattcagaacattttatacctaaaagtaattctgtctttcctaaagtgtttttaacatgaaaattagtaggaagatgtggttactatttggaaagtgtaatgtaacaaaactctcttttgttaccacaaattttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcaaaaaatgttatgtgcaatgaacactaaatttaagagcagttacagtgtgactcactcatgtttaaaaaaaatcgaagagctaaaaaatacgtctaatttatgtaacccattggaatgtatttctaggttctcttcaggattaattaaataaacatgcaatttatgaaaacatataaacaattatttatcacttttatgacccaaatcacaataaaattgtcatttaggataaactggggagaatagactgaacatatggttatattcacagttatttattaacttaaatgttattccaacattagagctaatgttaaaaagatttaaactgtaacgtctaatatttggaataatatattaaagtattagcactgtggttgattttcttgaattatgttgcatcttgtactactaagcttgtgaaaataaacatttggatgttttaaaaggtaaacatta

SEQ ID NO: 1257 - DNA, 1586 bp, Homo sapiens
  ENST00000581374
cctttctagggacagtttggataattttccgtgaaactggatgatctttgaatattaaatgaaaggagactagaataacagtctcttgactattcatgaaggagctttagcagaagcattctttcttggtgtgcaaatcacgcctggcagcccctgcccacagtacccgaagatggcaggccttgttcccttcacctaaattcataaacctgggtgtagtggcttctgatgctgatttgtttctcttttcagtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttat

SEQ ID NO: 1258 - DNA, 1169 bp, Homo sapiens
  ENST00000440832
gttcccatcgcccttgctagtcaccagaagctcctctcccctcaatgagttcactttctcaaaagacagccttcagcaccctggtttcctagaaggcttccccctaatccagagtctggggggagggggagattttcagaatgccatttcaaagcaatcaaatgcaaagctagaaaagacgaccccccccccccacgcacaccttgttttaatgctttatgttcgaaattaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatga

SEQ ID NO: 1259 - DNA, 606 bp, Homo sapiens
  ENST00000583022
atctttagctattttcaaactaggactccaagcttcttgcaaactctttgctaaataatgccttggtggcatgaggcacatccctaaaatagctaatttactcctagggaatttttgatgattcttaatagtgtgaaaactgattctggcagtatttaggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtg

SEQ ID NO: 1260 - DNA, 552 bp, Homo sapiens
  ENST00000584088
ctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattgggtaaccctcatattgatagttcccatcttcctacagttgaggacaattacctgtggggctcttttatttttcattattttg

SEQ ID NO: 1261 - DNA, 575 bp, Homo sapiens
  ENST00000578776
actctggctggggaaggcatgagtgacagacccacagcaaggcggtggggcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattg

SEQ ID NO: 1262 - DNA, 567 bp, Homo sapiens
  ENST00000383170
agacaagtggccgtaatctgactcccagcacacagggagctgcggggcaggcaatgagagctgcactctggctggggaaggcatgagtgacagacccacagcaaggcggtggggtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgag

SEQ ID NO: 1263 - DNA, 891 bp, Homo sapiens
  ENST00000622234
atgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatga

SEQ ID NO: 1264 - DNA, 2879 bp, Homo sapiens
  ENST00000379507
aggcagacttgagtctcctttctgtccatgggctcgggccactgtcttaggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcagcaatggggagaactggtggtgggtgccagtggtggcaccacttctgggtgcctatctaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgacagcagtacccccacttcctgggggcctcctgtggttgggcttccctcctgggttcttacaggagctccagggctatgtcttagcccaaggtgtagaggtgaggcacctcaagtctttcatgccctgggaactggggtgccccagggggagaatggggaagagatgacctgcgccctcagtaggaacagggtgagatgaaagaacgacagaatgagggattttcaggcacgggggaaggaagggtggttttggggaacagaccgtagctgactggttgggggccggctttggaaatactttgaggggatcctgagattggactctagactctcccctggttcttcccttccctgagttctggccggttcttggaccagacaaggcaaggcccaagaatgtagatcagaattttttagcctttttttcattagttccttccctagtattcttctagattttttttttcttaatcacatgaaattttaataccacagatgtactatatatctgtttatgttctgtatatgttctgtgctttatacataaaaaagagtaagatttttttttcacctccccttttaagaatcagttttaattcccttgagaatgcttgttatagattgaaggctgttaaggggttgggctcctctttcttcttcctggtgccagagtgctcccacatgaaggaataggaaaggaagatgcaaagagggaaatccttcgaccacatgaagacacaggaagaggcctcatagggctccaagggctccagggaagcaggtgcagaggttgggtggggtgaggggccaggatccactgaccctggggccaggcaggaatcactctgttgcctggggctcagaaggcagcatcacccatggttcctgtccttgctcatgcattttgcctttcaataattattgtgcatctactgtgtgcaggccctgcctggacactggggatgcgcagtggatgcgctgggctctgcctttgagggttgcagtttaatgggggacaggtaattatatggaagaaggtgagtgcagagtgggaggcttggaggctgtggggctcggggtaggggagctcacatccagcctctgggccaaggccaggaggcttcccagaggaggagacagagcagggtatggtggtggggggtgtcctttttgggggtgggagctgcactttacagtttgaggggatgggcagaggaggctgggcttcgttctggaggtggggacacggtgaggtgaggtttagaaagcacacctgagccgcagtgtgtaggatgctggaaatggtggagatgggcctgcgaaagtgatgacccaggagcagcagccgggcacctaacaatgggtcagcaccgtgggcgtggagacgagagcggggattgatcaataccggagaagtacaatgtacaggacttgggttccatttggatggagtgggtgagggagagggaggagtcagaaatggcttccggtttccagcttgggcctggggattggagatgtccccactgagagtagggcacaagtgaggaaatggtttggagaggaagataagttacatcatggacatgctgagtctgagttgcctatgggacttggaatggggggtggcaaaatgtgtgtgatcttgagcaagatattcaacccttctgggccttggtcttcttatttgtaaaatggcgataagaatattacttcccatttgtgttgctgtgaatattaaatgcgctaccacatgtaaaatgttgagaatca

SEQ ID NO: 1265 - DNA, 1668 bp, Homo sapiens
  ENST00000537089
tggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtcaacgctgtccctgaattgggctgaggctgaccagggccctgggttgggggtgtttcctggggtagcctggggatgactcctctgctcaacctgtcttggcccgaggtggatgagggtgctgtcctgggcatcagccccctcagcaggcctctgcctcttgcctgcagcaatggggagaactggtggtgggtgccagtggtggcaccacttctgggtgcctatctaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgacagcagtacccccacttcctgggggcctcctgtggttgggcttccctcctgggttcttacaggagctccagggctatgtcttagcccaaggtgtagaggtgaggcacctcaagtctttcatgccctgggaactggggtgccccagggggagaatggggaagagatgacctgcgccctcagtagga

SEQ ID NO: 1266 - DNA, 1068 bp, Homo sapiens
  ENST00000377425
ggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgaca

SEQ ID NO: 1267 - DNA, 1256 bp, Homo sapiens
  ENST00000297988
ggctctggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcagcaatggggagaactggtggtgggtgccagtggtggcaccacttctgggtgcctatctaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgaca

SEQ ID NO: 1268 - DNA, 474 bp, Homo sapiens
  ENST00000623097
agcgctcgaggccgccctgggagagctgagaggcaggctctggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtggcatcatctacctggtcttc

SEQ ID NO: 1269 - DNA, 675 bp, Homo sapiens
  ENST00000439678
gagtctcctttctgtccatgggctcgggccactgtcttaggtccacccgtggctccaaaatggtctcctggtccgtgatagcaaagatccaggaaatactgcagaggaagatggtgcgagagttcctggccgagttcatgagcacatatgtcatgatggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcagcaatggggagaactggtggtgggtgccagtggtggcaccact

SEQ ID NO: 1270 - DNA, 1062 bp, Homo sapiens
  ENST00000379506
gagtctcctttctgtccatgggctcgggccactgtcttaggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtcaacgctgtccctgaattgggctgaggctgaccagggccctgggttgggggtgtttcctggggtagcctggggatgactcctctgctcaacctgtcttggcccgaggtggatgag

SEQ ID NO: 1271 - DNA, 1270 bp, Homo sapiens
  ENST00000624075
cttactgacctctcccctggaggagcaggagcagcgctcgaggccgccctgggagagctgagaggcaggctctggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtcaacgctgtccctgaattgggctgaggctgaccagggccctgggttgggggtgtttcctggggtagcctggggatgactcctctgctcaacctgtctt

SEQ ID NO: 1272 - DNA, 1479 bp, Homo sapiens
  ENST00000624890
atagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcgaggcttgttggcaccgtggattgcactttcagctccccacccgcccatctgcaaagtggcctcattggtgtgccatttttactggtccagtcccaactagaaggggcatggcctggccatctaccccagttcctctccatgtccccgtggctctcaagtgtctccaattccagctgtcccagctgccctgcgcaagaggaggcgtgtgtgggcgaggctgctgggttacctattaactcagctgggagttgaagagccgatgggcagcaggcagacttgagtctcctttctgtccatgggctcgggccactgtcttaggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtcaacgctgtccctgaattgggctgaggctgaccagggccctgggttgggggtgtttcctggggtagcctggggatgact

SEQ ID NO: 1273 - DNA, 1026 bp, Homo sapiens
  ENST00000624005
agaactcggtctccacggcactgctggccggacgagggatgttattttgggcagtgcatctggacttggttcaagtggcaccagccaaacccctgccttactgacctctcccctggaggagcaggagcagcgctcgaggccgccctgggagagctgagaggcaggctctggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggagcccacatgaacgcagctgtgacctttgctaactgtgcgctgggccgcgtgccctggaggaagtttccggtctatgtgctggggcagttcctgggctccttcctggcggctgccaccatctacagtctcttctacagcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtc

SEQ ID NO: 1274 - DNA, 998 bp, Homo sapiens
  ENST00000447660
aaagcgccgatgagctgttctggagcacggggcccagcacagggtgagaggtgagatgcctgtggggaaatccaggagatagttaaacacatgcaaggggctggagctcaggagaggcttggtctggaaggaaaaagttgaagttcatcacaacacaggtggtagttgtcaatactgtccagagacagtgtacagaaagagaaaaggatgggttgaggacagagccctgaggaatgaagaagggcatgcaaaggagcctgagaaggaacggtcagagaggtgggaggagaaccagagcagactgcatgacagaggggggcagtggttccaccaggaagaagccgtcagcggcgtgggcagcggcagatgggccacgcgaggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaaca

SEQ ID NO: 1275 - DNA, 677 bp, Homo sapiens
  ENST00000379503
gttgcccttggagctggcctcctggctgtgggggagagttggatgggctgggccacattcactgatcagggagaggaggggctggagccatccgggccctggaaaaccagccatacacgagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggca

SEQ ID NO: 1276 - DNA, 973 bp, Homo sapiens
  ENST00000624420
gagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatgagagaaggtgatgactggtttggggttggagaagaaagcacatgtttgagagggctgtggaagacagaatcagggagactctgccagcagaagatgtgggcaaagcgccgatgagctgttctggagcacggggcccagcacagggtgagaggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggca

SEQ ID NO: 1277 - DNA, 875 bp, Homo sapiens
  ENST00000624095
gagttgaagagccgatgggcagcaggcagacttgagtctcctttctgtccatgggctcgggccactgtcttaggtccacccgtggctccaaaatggtctcctggtccgtgatagcaaagatccaggaaatactgcagaggaagatggtgcgagagttcctggccgagttcatgagcacatatgtcatgatgagagaaggtgatgactggtttggggttggagaagaaagcacatgtttgagagggctgtggaagacagaatcagggagactctgccagcagaagatgtgggcaaagcgccgatgagctgttctggagcacggggcccagcacagggtgagaggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttg

SEQ ID NO: 1278 - DNA, 575 bp, Homo sapiens
  ENST00000625109
aactcggtctccacggcactgctggccggacgagggatgttattttgggcagtgcatctggacttggttcaagtggcaccagccaaacccctgccttactgacctctcccctggaggagcaggagcagcgctcgaggccgccctgggagagctgagaggcaggctctggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggcgtggctgaccgggatgctccagctgtgtctcttcgccatcacggaccaggagaacaacccagcactgccaggaacagaggcgctggtgataggcat

SEQ ID NO: 1279 - DNA, 524 bp, Homo sapiens
  ENST00000624432
agtctcctttctgtccatgggctcgggccactgtcttaggtccacccgtggctccaaaatggtctcctggtccgtgatagcaaagatccaggaaatactgcagaggaagatggtgcgagagttcctggccgagttcatgagcacatatgtcatgatggagcccacatgaacgcagctgtgacctttgctaactgtgcgctgggccgcgtgccctggaggaagtttccggtctatgtgctggggcagttcctgggctccttcctggcggctgccaccatctacagtctcttctacagtgagtatcctgcccgggtgtccgcctctggcctcagccgcctcctatgaaatatgggcagattggacctcagtgtcctgatttgtaaaaaatagctgggagaaaaaagccttggagatcccccaccctctaacctataacctcatttctgggaccccggtggggcttagttgggagcaggttcgcatgacagtctgtgtctccgcagcggccattctccacttttcgg

SEQ ID NO: 1280 - DNA, 551 bp, Homo sapiens
  ENST00000623743
agagggaactgggctagagaatcaggaggacagacagggtgaggggacttcgggctaccttcatgctgtcagttagagataaagataggagtacaaaggggaatttttgggtgaggtacacgggtgaaatgagttttcagggcctcatcctgtgtgttcaccttctgtgtgtgtgtgtgtgcatgcgtgcatgtgtgtgtgtgtgcaggtcctggacagtcgcagcttaagttagcagcaagaggacttgaggttaaaggtatagcacgcaaatatgaggctggagccactgagtagaggctgagggcatctccacagtccaaagccgggctgcagacacggaagcatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggagcccacatgaacgcagctgtgacctttgctaactg

SEQ ID NO: 1281 - DNA, 585 bp, Homo sapiens
  ENST00000625032
gatgttattttgggcagtgcatctggacttggttcaagtggcaccagccaaacccctgccttactgacctctcccctggaggagcaggagcagcgctcgaggccgccctgggagagctgagaggcaggctctggactggggacacagggatagctgagccccagctgggggtggaagctgagccagggacagtcacggaggaacaagatcaagatgcgctgtaactgagaagcccccaaggcggaggctgagaatcagagacatttcagcagagtcctggacagtcgcagcttaagttagcagcaagaggacttgaggttaaaggtatagcacgcaaatatgaggctggagccactgagtagaggctgagggcatctccacagtccaaagccgggctgcagacacggaagcatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatgagagaa

SEQ ID NO: 1282 - DNA, 566 bp, Homo sapiens
  ENST00000623519
gacgagggatgttattttgggcagtgcatctggacttggttcaagtggcaccagccaaacccctgccttactgacctctcccctggaggagcaggagcagcgctcgaggccgccctgggagagctgagaggcaggctctggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtaagtaccccaccctcttctcaccctccagccccctgtccttcacccagcccacttcagtgccctccctgttccatcctcagcctctcccttggggcagctgtccccactcgacctcctcctccccacccacccactcgcctctgaggtcccagaagaagagcatcttccacctgttgcctgggctgggtcctggggtgaggggaggctcagaaatacttggatgagggtcaag

SEQ ID NO: 1283 - DNA, 2803 bp, Homo sapiens
  ENST00000536493
ccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatctttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaagacagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgacaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgttg

SEQ ID NO: 1284 - DNA, 588 bp, Homo sapiens
  ENST00000559443
aagtaccttgagaataaaggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattagcaggtttgcatttgcttctgctgggttccccaggtataccgccagccagaaatgattgctgtggagtggcaaactgaaaagagaagcctgggggatgcaggtgcctgttgaagagcactctcccaaaagaacggcactctgtgacctttctcccaactgtgaccgtaaatga

SEQ ID NO: 1285 - DNA, 3034 bp, Homo sapiens
  ENST00000219919
actgtgatttggcaacacaactggcacatctcttttctcatctcttgaaaaaaaccaacagagaaaaaagtaccttgagaataaaggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatctttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaagacagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgacaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgttg

SEQ ID NO: 1286 - DNA, 1334 bp, Homo sapiens
  ENST00000558772
aaaatcttttctggaccagggcccgtcactgtgatttggcaacacaactggcacatctcttttctcatctcttgaaaaaaaccaacagagaaaaaagtaccttgagaataaaggtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatctttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaagacagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggt

SEQ ID NO: 1287 - DNA, 10652 bp, Homo sapiens
  ENST00000374690
atcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaacaaaaaaaaaaagcaaaaacaaaacaaaaaataagccaaaaaaccttgctagtgttttttcctcaaaaataaataaataaataaataaatacgtacatacatacacacatacatacaaacatatagaaatccccaaagaggccaatagtgacgagaaggtgaaaattgcaggcccatggggagttactgattttttcatctcctccctccacgggagactttattttctgccaatggctattgccattagagggcagagtgaccccagagctgagttgggcaggggggtggacagagaggagaggacaaggagggcaatggagcatcagtacctgcccacagccttggtccctgggggctagactgctcaactgtggagcaattcattatactgaaaatgtgcttgttgttgaaaatttgtctgcatgttaatgcctcacccccaaacccttttctctctcactctctgcctccaacttcagattgactttcaatagtttttctaagacctttgaactgaatgttctcttcagccaaaacttggcgacttccacagaaaagtctgaccactgagaagaaggagagcagagatttaaccctttgtaaggccccatttggatccaggtctgctttctcatgtgtgagtcagggaggagctggagccagaggagaagaaaatgatagcttggctgttctcctgcttaggacactgactgaatagttaaactctcactgccactaccttttccccacctttaaaagacctgaatgaagttttctgccaaactccgtgaagccacaagcaccttatgtcctcccttcagtgttttgtgggcctgaatttcatcacactgcatttcagccatggtcatcaagcctgtttgcttcttttgggcatgttcacagattctctgttaagagcccccaccaccaagaaggttagcaggccaacagctctgacatctatctgtagatgccagtagtcacaaagatttcttaccaactctcagatcgctggagcccttagacaaactggaaagaaggcatcaaagggatcaggcaagctgggcgtcttgcccttgtcccccagagatgataccctcccagcaagtggagaagttctcacttccttctttagagcagctaaaggggctacccagatcagggttgaagagaaaactcaattaccagggtgggaagaatgaaggcactagaaccagaaaccctgcaaatgctcttcttgtcacccagcatatccacctgcagaagtcatgagaagagagaaggaacaaagaggagactctgactactgaattaaaatcttcagcggcaaagcctaaagccagatggacaccatctggtgagtttactcatcatcctcctctgctgctgattctgggctctgacattgcccatactcactcagattccccacctttgttgctgcctcttagtcagagggaggccaaaccattgagactttctacagaaccatggcttctttcggaaaggtctggttggtgtggctccaatactttgccacccatgaactcagggtgtgccctgggacactggttttatatagtcttttggcacacctgtgttctgttgacttcgttcttcaagcccaagtgcaagggaaaatgtccacctactttctcatcttggcctctgcctccttacttagctcttaatctcatctgttgaactcaagaaatcaagggccagtcatcaagctgcccattttaattgattcactctgtttgttgagaggatagtttctgagtgacatgatatgatccacaagggtttccttccctgatttctgcattgatattaatagccaaacgaacttcaaaacagctttaaataacaagggagaggggaacctaagatgagtaatatgccaatccaagactgctggagaaaactaaagctgacaggttccctttttggggtgggatagacatgttctggttttctttattattacacaatctggctcatgtacaggatcacttttagctgttttaaacagaaaaaaatatccaccactcttttcagttacactaggttacattttaataggtcctttacatctgttttggaatgattttcatcttttgtgatacacagattgaattatatcattttcatatctctccttgtaaatactagaagctctcctttacatttctctatcaaatttttcatctttatgggtttcccaattgtgactcttgtcttcatgaatatatgtttttcatttgcaaaagccaaaaatcagtgaaacagcagtgtaattaaaagcaacaactggattactccaaatttccaaatgacaaaactagggaaaaatagcctacacaagcctttaggcctactctttctgtgcttgggtttgagtgaacaaaggagattttagcttggctctgttctcccatggatgaaaggaggaggattttttttttcttttggccattgatgttctagccaatgtaattgacagaagtctcattttgcatgcgctctgctctacaaacagagttggtatggttggtatactgtactcacctgtgagggactggccactcagacccacttagctggtgagctagaagatgaggatcactcactggaaaagtcacaaggaccatctccaaacaagttggcagtgctcgatgtggacgaagagtgaggaagagaaaaagaaggagcaccagggagaaggctccgtctgtgctgggcagcagacagctgccaggatcacgaactctgtagtcaaagaaaagagtcgtgtggcagtttcagctctcgttcattgggcagctcgcctaggcccagcctctgagctgacatgggagttgttggattctttgtttcatagctttttctatgccataggcaatattgttgttcttggaaagtttattatttttttaactcccttactctgagaaagggatattttgaaggactgtcatatatctttgaaaaaagaaaatctgtaatacatatatttttatgtatgttcactggcactaaaaaatatagagagcttcattctgtcctttgggtagttgctgaggtaattgtccaggttgaaaaataatgtgctgatgctagagtccctctctgtccatactctacttctaaatacatataggcatacatagcaagttttatttgacttgtactttaagagaaaatatgtccaccatccacatgatgcacaaatgagctaacattgagcttcaagtagcttctaagtgtttgtttcattaggcacagcacagatgtggcctttccccccttctctcccttgatatctggcagggcataaaggcccaggccacttcctctgccccttcccagccctgcaccaaagctgcatttcaggagactctctccagacagcccagtaactacccgagcatggcccctgcatagccctggaaaaataagaggctgactgtctacgaattatcttgtgccagttgcccaggtgagagggcactgggccaagggagtggttttcatgtttgacccactacaaggggtcatgggaatcaggaatgccaaagcaccagatcaaatccaaaacttaaagtcaaaataagccattcagcatgttcagtttcttggaaaaggaagtttctacccctgatgcctttgtaggcagatctgttctcaccattaatctttttgaaaatcttttaaagcagtttttaaaaagagagatgaaagcatcacattatataaccaaagattacattgtacctgctaagataccaaaattcataagggcagggggggagcaagcattagtgcctctttgataagctgtccaaagacagactaaaggactctgctggtgactgacttataagagctttgtgggtttttttttccctaataatatacatgtttagaagaattgaaaataatttcgggaaaatgggattatgggtccttcactaagtgattttataagcagaactggctttccttttctctagtagttgctgagcaaattgttgaagctccatcattgcatggttggaaatggagctgttcttagccactgtgtttgctagtgcccatgttagcttatctgaagatgtgaaacccttgctgataagggagcatttaaagtactagattttgcactagagggacagcaggcagaaatccttatttctgcccactttggatggcacaaaaagttatctgcagttgaaggcagaaagttgaaatacattgtaaatgaatatttgtatccatgtttcaaaattgaaatatatatatatatatatatatatatatatatatatatatagtgtgtgtgtgtgttctgatagctttaactttctctgcatctttatatttggttccagatcacacctgatgccatgtacttgtgagagaggatgcagttttgttttggaagctctctcagaacaaacaagacacctggattgatcagttaactaaaagttttctcccctattgggtttgacccacaggtcctgtgaaggagcagagggataaaaagagtagaggacatgatacattgtactttactagttcaagacagatgaatgtggaaagcataaaaactcaatggaactgactgagatttaccacagggaaggcccaaacttggggccaaaagcctacccaagtgattgaccagtggccccctaatgggacctgagctgttggaagaagagaactgttccttggtcttcaccatccttgtgagagaagggcagtttcctgcattggaacctggagcaagcgctctatctttcacacaaattccctcacctgagattgaggtgctcttgttactgggtgtctgtgtgctgtaattctggttttggatatgttctgtaaagattttgacaaatgaaaatgtgtttttctctgttaaaacttgtcagagtactagaagttgtatctctgtaggtgcaggtccatttctgcccacaggtagggtgtttttctttgattaagagattgacacttctgttgcctaggacctcccaactcaaccatttctaggtgaaggcagaaaaatccacattagttactcctcttcagacatttcagctgagataacaaatcttttggaattttttcacccatagaaagagtggtagatatttgaatttagcaggtggagtttcatagtaaaaacagcttttgactcagctttgatttatcctcatttgatttggccagaaagtaggtaatatgcattgattggcttctgattccaattcagtatagcaaggtgctaggttttttcctttccccacctgtctcttagcctggggaattaaatgagaagccttagaatgggtggcccttgtgacctgaaacacttcccacataagctacttaacaagattgtcatggagctgcagattccattgcccaccaaagactagaacacacacatatccatacaccaaaggaaagacaattctgaaatgctgtttctctggtggttccctctctggctgctgcctcacagtatgggaacctgtactctgcagaggtgacaggccagatttgcattatctcacaaccttagcccttggtgctaactgtcctacagtgaagtgcctggggggttgtcctatcccataagccacttggatgctgacagcagccaccatcagaatgacccacgcaaaaaaaagaaaaaaaaaattaaaaagtcccctcacaacccagtgacacctttctgctttcctctagactggaacattgattagggagtgcctcagacatgacattcttgtgctgtccttggaattaatctggcagcaggagggagcagactatgtaaacagagataaaaattaattttcaatattgaaggaaaaaagaaataagaagagagagagaaagaaagcatcacacaaagattttcttaaaagaaacaattttgcttgaaatctctttagatggggctcatttctcacggtggcacttggcctccactgggcagcaggaccagctccaagcgctagtgttctgttctctttttgtaatcttggaatcttttgttgctctaaatacaattaaaaatggcagaaacttgtttgttggactacatgtgtgactttgggtctgtctctgcctctgctttcagaaatgtcatccattgtgtaaaatattggcttactggtctgccagctaaaacttggccacatcccctgttatggctgcaggatcgagttattgttaacaaagagacccaagaaaagctgctaatgtcctcttatcattgttgttaatttgttaaaacataaagaaatctaaaatttca

SEQ ID NO: 1288 - DNA, 2420 bp, Homo sapiens
  ENST00000513847
gacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcagctgttgttgtttctgaaagaatcttgagggtgtttggagtctcagaatggcttccttaaagactaccttcagactctcagctgctcatccacaacagagatcagcctttctttgtagatgattcattcctggctgcatttgaaaaccacatattgttaattgcttgacgaatttaaatcccttgactacttttcatttcagaaaa

SEQ ID NO: 1289 - DNA, 3615 bp, Homo sapiens
  ENST00000504326
gacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacacc

SEQ ID NO: 1290 - DNA, 3899 bp, Homo sapiens
  ENST00000514029
gacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaaggatttttcagaatgaacaaattaaaagaatcataatcagacactaaccccaagccatactgcatggcagcaccaatgggactgacagaaaacaacagaaataggaagaaatcctacagagaaacaaacttgaaagctgtctcatggcctttgaatcatacttaagttttatgatggaaggatacgactatgaagaaagacacagagcaacatcagacagtcaagaatttcagagccagctggcatgcagtggacctcatgccagcccattttatgactatttagggaaacagaagtacctgtgcgccagcagaaatgattgcactattgataaattccgaaggaaaaattgtccatcttgtcgtcttcggaaatgttatgaagcagggatgactctgggagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacacc

SEQ ID NO: 1291 - DNA, 1728 bp, Homo sapiens
  ENST00000396043
gcctatgcaaatgcctgcctgaagctgctggaggctggctttgtaccggactttgtacagggaaccagggaaacgaatgcagagtgctcctgacattgcctgtcactttttcccatgatactctggcttcacagtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaacaaaaaaaaaaa

SEQ ID NO: 1292 - DNA, 3896 bp, Homo sapiens
  ENST00000612010
gacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaaggatttttcagaatgaacaaattaaaagaatcatcagacactaaccccaagccatactgcatggcagcaccaatgggactgacagaaaacaacagaaataggaagaaatcctacagagaaacaaacttgaaagctgtctcatggcctttgaatcatacttaagttttatgatggaaggatacgactatgaagaaagacacagagcaacatcagacagtcaagaatttcagagccagctggcatgcagtggacctcatgccagcccattttatgactatttagggaaacagaagtacctgtgcgccagcagaaatgattgcactattgataaattccgaaggaaaaattgtccatcttgtcgtcttcggaaatgttatgaagcagggatgactctgggagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacacc

SEQ ID NO: 1293 - DNA, 3532 bp, Homo sapiens
  ENST00000613054
gacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgaaatacccgaagaaagagactctggaaactcattatcaggtctatcaactcttgtatttgttctcccagggaaacagaagtacctgtgcgccagcagaaatgattgcactattgataaattccgaaggaaaaattgtccatcttgtcgtcttcggaaatgttatgaagcagggatgactctgggagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacacc

SEQ ID NO: 1294 - DNA, 10676 bp, Homo sapiens
  ENST00000612452
cgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattaaagccaatttatttgctagaattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaacaaaaaaaaaaagcaaaaacaaaacaaaaaataagccaaaaaaccttgctagtgttttttcctcaaaaataaataaataaataaataaatacgtacatacatacacacatacatacaaacatatagaaatccccaaagaggccaatagtgacgagaaggtgaaaattgcaggcccatggggagttactgattttttcatctcctccctccacgggagactttattttctgccaatggctattgccattagagggcagagtgaccccagagctgagttgggcaggggggtggacagagaggagaggacaaggagggcaatggagcatcagtacctgcccacagccttggtccctgggggctagactgctcaactgtggagcaattcattatactgaaaatgtgcttgttgttgaaaatttgtctgcatgttaatgcctcacccccaaacccttttctctctcactctctgcctccaacttcagattgactttcaatagtttttctaagacctttgaactgaatgttctcttcagccaaaacttggcgacttccacagaaaagtctgaccactgagaagaaggagagcagagatttaaccctttgtaaggccccatttggatccaggtctgctttctcatgtgtgagtcagggaggagctggagccagaggagaagaaaatgatagcttggctgttctcctgcttaggacactgactgaatagttaaactctcactgccactaccttttccccacctttaaaagacctgaatgaagttttctgccaaactccgtgaagccacaagcaccttatgtcctcccttcagtgttttgtgggcctgaatttcatcacactgcatttcagccatggtcatcaagcctgtttgcttcttttgggcatgttcacagattctctgttaagagcccccaccaccaagaaggttagcaggccaacagctctgacatctatctgtagatgccagtagtcacaaagatttcttaccaactctcagatcgctggagcccttagacaaactggaaagaaggcatcaaagggatcaggcaagctgggcgtcttgcccttgtcccccagagatgataccctcccagcaagtggagaagttctcacttccttctttagagcagctaaaggggctacccagatcagggttgaagagaaaactcaattaccagggtgggaagaatgaaggcactagaaccagaaaccctgcaaatgctcttcttgtcacccagcatatccacctgcagaagtcatgagaagagagaaggaacaaagaggagactctgactactgaattaaaatcttcagcggcaaagcctaaagccagatggacaccatctggtgagtttactcatcatcctcctctgctgctgattctgggctctgacattgcccatactcactcagattccccacctttgttgctgcctcttagtcagagggaggccaaaccattgagactttctacagaaccatggcttctttcggaaaggtctggttggtgtggctccaatactttgccacccatgaactcagggtgtgccctgggacactggttttatatagtcttttggcacacctgtgttctgttgacttcgttcttcaagcccaagtgcaagggaaaatgtccacctactttctcatcttggcctctgcctccttacttagctcttaatctcatctgttgaactcaagaaatcaagggccagtcatcaagctgcccattttaattgattcactctgtttgttgagaggatagtttctgagtgacatgatatgatccacaagggtttccttccctgatttctgcattgatattaatagccaaacgaacttcaaaacagctttaaataacaagggagaggggaacctaagatgagtaatatgccaatccaagactgctggagaaaactaaagctgacaggttccctttttggggtgggatagacatgttctggttttctttattattacacaatctggctcatgtacaggatcacttttagctgttttaaacagaaaaaaatatccaccactcttttcagttacactaggttacattttaataggtcctttacatctgttttggaatgattttcatcttttgtgatacacagattgaattatatcattttcatatctctccttgtaaatactagaagctctcctttacatttctctatcaaatttttcatctttatgggtttcccaattgtgactcttgtcttcatgaatatatgtttttcatttgcaaaagccaaaaatcagtgaaacagcagtgtaattaaaagcaacaactggattactccaaatttccaaatgacaaaactagggaaaaatagcctacacaagcctttaggcctactctttctgtgcttgggtttgagtgaacaaaggagattttagcttggctctgttctcccatggatgaaaggaggaggattttttttttcttttggccattgatgttctagccaatgtaattgacagaagtctcattttgcatgcgctctgctctacaaacagagttggtatggttggtatactgtactcacctgtgagggactggccactcagacccacttagctggtgagctagaagatgaggatcactcactggaaaagtcacaaggaccatctccaaacaagttggcagtgctcgatgtggacgaagagtgaggaagagaaaaagaaggagcaccagggagaaggctccgtctgtgctgggcagcagacagctgccaggatcacgaactctgtagtcaaagaaaagagtcgtgtggcagtttcagctctcgttcattgggcagctcgcctaggcccagcctctgagctgacatgggagttgttggattctttgtttcatagctttttctatgccataggcaatattgttgttcttggaaagtttattatttttttaactcccttactctgagaaagggatattttgaaggactgtcatatatctttgaaaaaagaaaatctgtaatacatatatttttatgtatgttcactggcactaaaaaatatagagagcttcattctgtcctttgggtagttgctgaggtaattgtccaggttgaaaaataatgtgctgatgctagagtccctctctgtccatactctacttctaaatacatataggcatacatagcaagttttatttgacttgtactttaagagaaaatatgtccaccatccacatgatgcacaaatgagctaacattgagcttcaagtagcttctaagtgtttgtttcattaggcacagcacagatgtggcctttccccccttctctcccttgatatctggcagggcataaaggcccaggccacttcctctgccccttcccagccctgcaccaaagctgcatttcaggagactctctccagacagcccagtaactacccgagcatggcccctgcatagccctggaaaaataagaggctgactgtctacgaattatcttgtgccagttgcccaggtgagagggcactgggccaagggagtggttttcatgtttgacccactacaaggggtcatgggaatcaggaatgccaaagcaccagatcaaatccaaaacttaaagtcaaaataagccattcagcatgttcagtttcttggaaaaggaagtttctacccctgatgcctttgtaggcagatctgttctcaccattaatctttttgaaaatcttttaaagcagtttttaaaaagagagatgaaagcatcacattatataaccaaagattacattgtacctgctaagataccaaaattcataagggcagggggggagcaagcattagtgcctctttgataagctgtccaaagacagactaaaggactctgctggtgactgacttataagagctttgtgggtttttttttccctaataatatacatgtttagaagaattgaaaataatttcgggaaaatgggattatgggtccttcactaagtgattttataagcagaactggctttccttttctctagtagttgctgagcaaattgttgaagctccatcattgcatggttggaaatggagctgttcttagccactgtgtttgctagtgcccatgttagcttatctgaagatgtgaaacccttgctgataagggagcatttaaagtactagattttgcactagagggacagcaggcagaaatccttatttctgcccactttggatggcacaaaaagttatctgcagttgaaggcagaaagttgaaatacattgtaaatgaatatttgtatccatgtttcaaaattgaaatatatatatatatatatatatatatatatatatatatatagtgtgtgtgtgtgttctgatagctttaactttctctgcatctttatatttggttccagatcacacctgatgccatgtacttgtgagagaggatgcagttttgttttggaagctctctcagaacaaacaagacacctggattgatcagttaactaaaagttttctcccctattgggtttgacccacaggtcctgtgaaggagcagagggataaaaagagtagaggacatgatacattgtactttactagttcaagacagatgaatgtggaaagcataaaaactcaatggaactgactgagatttaccacagggaaggcccaaacttggggccaaaagcctacccaagtgattgaccagtggccccctaatgggacctgagctgttggaagaagagaactgttccttggtcttcaccatccttgtgagagaagggcagtttcctgcattggaacctggagcaagcgctctatctttcacacaaattccctcacctgagattgaggtgctcttgttactgggtgtctgtgtgctgtaattctggttttggatatgttctgtaaagattttgacaaatgaaaatgtgtttttctctgttaaaacttgtcagagtactagaagttgtatctctgtaggtgcaggtccatttctgcccacaggtagggtgtttttctttgattaagagattgacacttctgttgcctaggacctcccaactcaaccatttctaggtgaaggcagaaaaatccacattagttactcctcttcagacatttcagctgagataacaaatcttttggaattttttcacccatagaaagagtggtagatatttgaatttagcaggtggagtttcatagtaaaaacagcttttgactcagctttgatttatcctcatttgatttggccagaaagtaggtaatatgcattgattggcttctgattccaattcagtatagcaaggtgctaggttttttcctttccccacctgtctcttagcctggggaattaaatgagaagccttagaatgggtggcccttgtgacctgaaacacttcccacataagctacttaacaagattgtcatggagctgcagattccattgcccaccaaagactagaacacacacatatccatacaccaaaggaaagacaattctgaaatgctgtttctctggtggttccctctctggctgctgcctcacagtatgggaacctgtactctgcagaggtgacaggccagatttgcattatctcacaaccttagcccttggtgctaactgtcctacagtgaagtgcctggggggttgtcctatcccataagccacttggatgctgacagcagccaccatcagaatgacccacgcaaaaaaaagaaaaaaaaaattaaaaagtcccctcacaacccagtgacacctttctgctttcctctagactggaacattgattagggagtgcctcagacatgacattcttgtgctgtccttggaattaatctggcagcaggagggagcagactatgtaaacagagataaaaattaattttcaatattgaaggaaaaaagaaataagaagagagagagaaagaaagcatcacacaaagattttcttaaaagaaacaattttgcttgaaatctctttagatggggctcatttctcacggtggcacttggcctccactgggcagcaggaccagctccaagcgctagtgttctgttctctttttgtaatcttggaatcttttgttgctctaaatacaattaaaaatggcagaaacttgtttgttggactacatgtgtgactttgggtctgtctctgcctctgctttcagaaatgtcatccattgtgtaaaatattggcttactggtctgccagctaaaacttggccacatcccctgttatggctgcaggatcgagttattgttaacaaagagacccaagaaaagctgctaatgtcctcttatcattgttgttaatttgttaaaacataaagaaatctaaaatttc

SEQ ID NO: 1295 - DNA, 10221 bp, Homo sapiens
  ENST00000396044
cgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctgattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaacaaaaaaaaaaagcaaaaacaaaacaaaaaataagccaaaaaaccttgctagtgttttttcctcaaaaataaataaataaataaataaatacgtacatacatacacacatacatacaaacatatagaaatccccaaagaggccaatagtgacgagaaggtgaaaattgcaggcccatggggagttactgattttttcatctcctccctccacgggagactttattttctgccaatggctattgccattagagggcagagtgaccccagagctgagttgggcaggggggtggacagagaggagaggacaaggagggcaatggagcatcagtacctgcccacagccttggtccctgggggctagactgctcaactgtggagcaattcattatactgaaaatgtgcttgttgttgaaaatttgtctgcatgttaatgcctcacccccaaacccttttctctctcactctctgcctccaacttcagattgactttcaatagtttttctaagacctttgaactgaatgttctcttcagccaaaacttggcgacttccacagaaaagtctgaccactgagaagaaggagagcagagatttaaccctttgtaaggccccatttggatccaggtctgctttctcatgtgtgagtcagggaggagctggagccagaggagaagaaaatgatagcttggctgttctcctgcttaggacactgactgaatagttaaactctcactgccactaccttttccccacctttaaaagacctgaatgaagttttctgccaaactccgtgaagccacaagcaccttatgtcctcccttcagtgttttgtgggcctgaatttcatcacactgcatttcagccatggtcatcaagcctgtttgcttcttttgggcatgttcacagattctctgttaagagcccccaccaccaagaaggttagcaggccaacagctctgacatctatctgtagatgccagtagtcacaaagatttcttaccaactctcagatcgctggagcccttagacaaactggaaagaaggcatcaaagggatcaggcaagctgggcgtcttgcccttgtcccccagagatgataccctcccagcaagtggagaagttctcacttccttctttagagcagctaaaggggctacccagatcagggttgaagagaaaactcaattaccagggtgggaagaatgaaggcactagaaccagaaaccctgcaaatgctcttcttgtcacccagcatatccacctgcagaagtcatgagaagagagaaggaacaaagaggagactctgactactgaattaaaatcttcagcggcaaagcctaaagccagatggacaccatctggtgagtttactcatcatcctcctctgctgctgattctgggctctgacattgcccatactcactcagattccccacctttgttgctgcctcttagtcagagggaggccaaaccattgagactttctacagaaccatggcttctttcggaaaggtctggttggtgtggctccaatactttgccacccatgaactcagggtgtgccctgggacactggttttatatagtcttttggcacacctgtgttctgttgacttcgttcttcaagcccaagtgcaagggaaaatgtccacctactttctcatcttggcctctgcctccttacttagctcttaatctcatctgttgaactcaagaaatcaagggccagtcatcaagctgcccattttaattgattcactctgtttgttgagaggatagtttctgagtgacatgatatgatccacaagggtttccttccctgatttctgcattgatattaatagccaaacgaacttcaaaacagctttaaataacaagggagaggggaacctaagatgagtaatatgccaatccaagactgctggagaaaactaaagctgacaggttccctttttggggtgggatagacatgttctggttttctttattattacacaatctggctcatgtacaggatcacttttagctgttttaaacagaaaaaaatatccaccactcttttcagttacactaggttacattttaataggtcctttacatctgttttggaatgattttcatcttttgtgatacacagattgaattatatcattttcatatctctccttgtaaatactagaagctctcctttacatttctctatcaaatttttcatctttatgggtttcccaattgtgactcttgtcttcatgaatatatgtttttcatttgcaaaagccaaaaatcagtgaaacagcagtgtaattaaaagcaacaactggattactccaaatttccaaatgacaaaactagggaaaaatagcctacacaagcctttaggcctactctttctgtgcttgggtttgagtgaacaaaggagattttagcttggctctgttctcccatggatgaaaggaggaggattttttttttcttttggccattgatgttctagccaatgtaattgacagaagtctcattttgcatgcgctctgctctacaaacagagttggtatggttggtatactgtactcacctgtgagggactggccactcagacccacttagctggtgagctagaagatgaggatcactcactggaaaagtcacaaggaccatctccaaacaagttggcagtgctcgatgtggacgaagagtgaggaagagaaaaagaaggagcaccagggagaaggctccgtctgtgctgggcagcagacagctgccaggatcacgaactctgtagtcaaagaaaagagtcgtgtggcagtttcagctctcgttcattgggcagctcgcctaggcccagcctctgagctgacatgggagttgttggattctttgtttcatagctttttctatgccataggcaatattgttgttcttggaaagtttattatttttttaactcccttactctgagaaagggatattttgaaggactgtcatatatctttgaaaaaagaaaatctgtaatacatatatttttatgtatgttcactggcactaaaaaatatagagagcttcattctgtcctttgggtagttgctgaggtaattgtccaggttgaaaaataatgtgctgatgctagagtccctctctgtccatactctacttctaaatacatataggcatacatagcaagttttatttgacttgtactttaagagaaaatatgtccaccatccacatgatgcacaaatgagctaacattgagcttcaagtagcttctaagtgtttgtttcattaggcacagcacagatgtggcctttccccccttctctcccttgatatctggcagggcataaaggcccaggccacttcctctgccccttcccagccctgcaccaaagctgcatttcaggagactctctccagacagcccagtaactacccgagcatggcccctgcatagccctggaaaaataagaggctgactgtctacgaattatcttgtgccagttgcccaggtgagagggcactgggccaagggagtggttttcatgtttgacccactacaaggggtcatgggaatcaggaatgccaaagcaccagatcaaatccaaaacttaaagtcaaaataagccattcagcatgttcagtttcttggaaaaggaagtttctacccctgatgcctttgtaggcagatctgttctcaccattaatctttttgaaaatcttttaaagcagtttttaaaaagagagatgaaagcatcacattatataaccaaagattacattgtacctgctaagataccaaaattcataagggcagggggggagcaagcattagtgcctctttgataagctgtccaaagacagactaaaggactctgctggtgactgacttataagagctttgtgggtttttttttccctaataatatacatgtttagaagaattgaaaataatttcgggaaaatgggattatgggtccttcactaagtgattttataagcagaactggctttccttttctctagtagttgctgagcaaattgttgaagctccatcattgcatggttggaaatggagctgttcttagccactgtgtttgctagtgcccatgttagcttatctgaagatgtgaaacccttgctgataagggagcatttaaagtactagattttgcactagagggacagcaggcagaaatccttatttctgcccactttggatggcacaaaaagttatctgcagttgaaggcagaaagttgaaatacattgtaaatgaatatttgtatccatgtttcaaaattgaaatatatatatatatatatatatatatatatatatatatatagtgtgtgtgtgtgttctgatagctttaactttctctgcatctttatatttggttccagatcacacctgatgccatgtacttgtgagagaggatgcagttttgttttggaagctctctcagaacaaacaagacacctggattgatcagttaactaaaagttttctcccctattgggtttgacccacaggtcctgtgaaggagcagagggataaaaagagtagaggacatgatacattgtactttactagttcaagacagatgaatgtggaaagcataaaaactcaatggaactgactgagatttaccacagggaaggcccaaacttggggccaaaagcctacccaagtgattgaccagtggccccctaatgggacctgagctgttggaagaagagaactgttccttggtcttcaccatccttgtgagagaagggcagtttcctgcattggaacctggagcaagcgctctatctttcacacaaattccctcacctgagattgaggtgctcttgttactgggtgtctgtgtgctgtaattctggttttggatatgttctgtaaagattttgacaaatgaaaatgtgtttttctctgttaaaacttgtcagagtactagaagttgtatctctgtaggtgcaggtccatttctgcccacaggtagggtgtttttctttgattaagagattgacacttctgttgcctaggacctcccaactcaaccatttctaggtgaaggcagaaaaatccacattagttactcctcttcagacatttcagctgagataacaaatcttttggaattttttcacccatagaaagagtggtagatatttgaatttagcaggtggagtttcatagtaaaaacagcttttgactcagctttgatttatcctcatttgatttggccagaaagtaggtaatatgcattgattggcttctgattccaattcagtatagcaaggtgctaggttttttcctttccccacctgtctcttagcctggggaattaaatgagaagccttagaatgggtggcccttgtgacctgaaacacttcccacataagctacttaacaagattgtcatggagctgcagattccattgcccaccaaagactagaacacacacatatccatacaccaaaggaaagacaattctgaaatgctgtttctctggtggttccctctctggctgctgcctcacagtatgggaacctgtactctgcagaggtgacaggccagatttgcattatctcacaaccttagcccttggtgctaactgtcctacagtgaagtgcctggggggttgtcctatcccataagccacttggatgctgacagcagccaccatcagaatgacccacgcaaaaaaaagaaaaaaaaaattaaaaagtcccctcacaacccagtgacacctttctgctttcctctagactggaacattgattagggagtgcctcagacatgacattcttgtgctgtccttggaattaatctggcagcaggagggagcagactatgtaaacagagataaaaattaattttcaatattgaaggaaaaaagaaataagaagagagagagaaagaaagcatcacacaaagattttcttaaaagaaacaattttgcttgaaatctctttagatggggctcatttctcacggtggcacttggcctccactgggcagcaggaccagctccaagcgctagtgttctgttctctttttgtaatcttggaatcttttgttgctctaaatacaattaaaaatggcagaaacttgtttgttggactacatgtgtgactttgggtctgtctctgcctctgctttcagaaatgtcatccattgtgtaaaatattggcttactggtctgccagctaaaacttggccacatcccctgttatggctgcaggatcgagttattgttaacaaagagacccaagaaaagctgctaatgtcctcttatcattgttgttaatttgttaaaacataaagaaatctaaaatttc

SEQ ID NO: 1296 - DNA, 4927 bp, Homo sapiens
  ENST00000508305
acccgcgagcggacggcggccgcgtagtgaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggcctcctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagac

SEQ ID NO: 1297 - DNA, 5250 bp, Homo sapiens
  ENST00000239440
ctcggacgagcggcgggcacccgcgagcggacggcggccgcgtagtgagcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggcctcctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaaggcgaggagccctggttccccccagcccctgatggcagctgccctggcctcttgccctcagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagac

SEQ ID NO: 1298 - DNA, 3179 bp, Homo sapiens
  ENST00000512390
ttttctctgcttttcgctaccccggtcactctcatttctctcccctattccttgtctcttcccccatccccctttctcctgtcctccccctgcctctacagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctggtattcctaagatccctgagagccaaggcccaaccaggatctctgccttcccccaccagaatccatggtttggcagccctccgccccatcacttcccaccctgggggatcatccagagacttggctcagggggaggtgggaagggggcagagacacatccatcctgcatttgtgcctaaaaatccctccctctgtaccagctgccactctttcttcccgggtcctccccaaccctcctccattccatccccagagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaacc

SEQ ID NO: 1299 - DNA, 3810 bp, Homo sapiens
  ENST00000513878
atgggtcattgagctctctctctccaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaaggcgaggagccctggttccccccagcccctgatggcagctgccctggcctcttgccctcagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcc

SEQ ID NO: 1300 - DNA, 1765 bp, Homo sapiens
  ENST00000504448
gtgcagtcaggcaggagcagagctttgacccagacccagggtgggcaggaactgaggggccaactctagcactgacttactgtgaacctggggcaagccccttcccctctctgggcctcagtttccttaacttcaaatgaagtcccttccctaagtagagagccattgctgttgttctgggatggctctgcttccagatcgcaggcctttcagcatctttctttggaggaagattggaggctggtgctcactgtccaggcctcagactctggggcagagagggggattctcagcctgagccctcccttcaccctgcccctccccccagcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggcctcctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagct

SEQ ID NO: 1301 - DNA, 533 bp, Homo sapiens
  ENST00000524066
agatgtgacgatatggagatgagggagagggagggctgagaggggctcagaattggaaggagggaagtccattgtgtgtgtgggcggggcagtgactgcatgactgatgtcagcatttaaagtagctggcttagcagctgtacccactgcttgtggatttaatgccaatcttataaaatctggggcaggacccaggggctggcacacatggctcagttcctgtcctcatgggtcattgagctctctctctccaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctgga

SEQ ID NO: 1302 - DNA, 4928 bp, Homo sapiens
  ENST00000626478
agcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggcctcctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaag

SEQ ID NO: 1303 - DNA, 2948 bp, Homo sapiens
  ENST00000356613
tcgggcgcggcgtcctccctccgcagcagccgagccggacctgcctccccgggcgtgctccgccggccccgccgccggcccgcagcgacagacaggcgctccccgcagctccgcacgggacccaggccgccggaccccagcgccggaccaccctctgtccgccccgaggagtttgccgcctgccggagcacctgcgcacagatggagctggaccaccggaccagcggcgggctccacgcctaccccgggccgcggggcgggcaggtggccaagcccaacgtgatcctgcagatcgggaagtgccgggccgagatgctggagcacgtgcggcggacgcaccggcacctgctggccgaggtgtccaagcaggtggagcgcgagctgaaggggctgcaccggtcggtcgggaagctggagagcaacctggacggctacgtgcccacgagcgactcgcagcgctggaagaagtccatcaaggcctgcctgtgccgctgccaggagaccatcgccaacctggagcgctgggtcaagcgcgagatgcacgtgtggcgcgaggtgttctaccgcctggagcgctgggccgaccgcctggagtccacgggcggcaagtacccggtgggcagcgagtcagcccgccacaccgtttccgtgggcgtggggggtcccgagagctactgccacgaggcagacggctacgactacaccgtcagcccctacgccatcaccccgcccccagccgctggcgagctgcccgggcaggagcccgccgaggcccagcagtaccagccgtgggtccccggcgaggacgggcagcccagccccggcgtggacacgcagatcttcgaggaccctcgagagttcctgagccacctagaggagtacttgcggcaggtgggcggctctgaggagtactggctgtcccagatccagaatcacatgaacgggccggccaagaagtggtgggagttcaagcagggctccgtgaagaactgggtggagttcaagaaggagttcctgcagtacagcgagggcacgctgtcccgagaggccatccagcgcgagctggacctgccgcagaagcagggcgagccgctggaccagttcctgtggcgcaagcgggacctgtaccagacgctctacgtggacgcggacgaggaggagatcatccagtacgtggtgggcaccctgcagcccaagctcaagcgtttcctgcgccaccccctgcccaagaccctggagcagctcatccagaggggcatggaggtgcaggatgacctggagcaggcggccgagccggccggcccccacctcccggtggaggatgaggcggagaccctcacgcccgcccccaacagcgagtccgtggccagtgaccggacccagcccgagtagagggcatcccggagcccccagcctgcccactacatccagcctgtggctttgcccaccaggacttttgagctggggctgactcctgcaggggaagccctggtccagctgggtgccccctcgagctccgggcggactcgcacacactcgtgtcatccagatgtgagcaccgcacccagcggcaaagagccctcccccctgcagggctccacccatcaccctccctccgtctgtctttccggcctggaccccaccctccacactctcaggccatcacagaacaccccagcttcctcattctgctacaacacccaggccctctggacatccagaaaaccaagtgtccggatggcaggggccagcggccaccaagctcatgggacacccagagcagaagctagggcagagccaatgctgagggagcctcgacttccggcgccgccgccctctcccggcatccgcagagccagctgacgccctccctgcctcccagggcagctggccagcctcgggcagcgcggccccctcctcccaggggagagtagaagtcgcacacgcagcagagcagacctgatgtcccggtgcttcctggcccctcagctccagtgattcacgcccgcctggagaagaatcagagctcagctcatgactcacccatggcaggcggagggtcccagaggggctgagtcctcaaatccggctgaggcagcagctggcaccatcagagccaggagagtgacaacaggtctcaaggttcccacaaagtctttgctgctgtgctgggcaccacccacccctcaccttgcaggctgcctgcgtgggaggcgaagtcccaggacagcccagaggggggctacagagaggagtcggctgcagcagagggcaggagccccagcttagccctgagcgccagcgcgaggaccagggcctgccactaagcccgccccgctggccgccagctgcccgtccccagagccactgcagcaggagtcgggccctgcctccctcccagcagggaaaccccgcccgctgccaggccatcctctctgccagaggctttcatgagccccaaggctggggccacagctcctacccctgcccagcagccctgagctcagctgcaggaaggacatcccagaagccatggctcctggggcgcttccaggcattctgccctgccccgacaccagaaccctggtgctggtgggccactagcgtctgcagcctaagcaggtgctggctcagggttcatcgttctgccttgtccactgggggaccagccctgcagaccactctgacaagtcttcagcccacaccctgccagccccacagattttatttttgcacataagccataaccaatcctcaaggctggcacaggctttggggaagccctggagcctgtgaagaccctggaaacctcatgaggctgtggccaacccctgccccttgccccacacagaccaggccttaaatgtcggtccaggccctgtgcaccttaccccagagacagactctttttgtaagattttgttaataaaacactgaaacttcctgga

SEQ ID NO: 1304 - DNA, 407 bp, Homo sapiens
  ENST00000581404
acacccagagcagaagctagggcagagccaatgctgagggagcctcgacttccggcgccgccgccctctcccggcatccgcagagccagctgacgccctccctgcctcccagggcagctggccagcctcgggcagcgcggccccctcctcccaggggagagtagaagtcgcacacgcagcagagcagacctgatgtcccggtgcttcctggcccctcagctccagtgattcacgcccgcctggagaagaatcagagctcagctcatgactcacccatggcaggcggagggtcccagaggggctgagtcctcaaatccggctgaggcagcagctggcaccatcagagccaggagagtgacaacaggtaacggagcaccacccttccacccagaccccaccatcagctg

SEQ ID NO: 1305 - DNA, 1660 bp, Homo sapiens
  ENST00000303436
gccgcggccgccgcgtgacgtggcacagccagagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 1306 - DNA, 1467 bp, Homo sapiens
  ENST00000496292
taccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatgggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaat

SEQ ID NO: 1307 - DNA, 1360 bp, Homo sapiens
  ENST00000489843
caggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatt

SEQ ID NO: 1308 - DNA, 1601 bp, Homo sapiens
  ENST00000486310
ctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattgcggtcatttttgtttttctttgtaggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcata

SEQ ID NO: 1309 - DNA, 404 bp, Homo sapiens
  ENST00000483848
agcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattgggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaaca

SEQ ID NO: 1310 - DNA, 641 bp, Homo sapiens
  ENST00000463880
gcgcaagcgcagtggctcgggcgcaccggaagcgcagggggatggggcggcggtgacgcgattctgtccgcgttggaggggccgggccgctgctggagtcgccgcggccgccgcgtgacgtggcacagccagagcctaaaggctagagccggagctgccgcgccagtcgcctagcagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaa

SEQ ID NO: 1311 - DNA, 548 bp, Homo sapiens
  ENST00000493378
cggccgccgcgtgacgtggcacagccagagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttattttcttaatgacgctgcacagcggtcatttttgtttttctttgtaggttttaatgtggaaacagtagaatataagaacatttgtttcacagtatgggatgttggtggtcaagatagaattaggcctctc

SEQ ID NO: 1312 - DNA, 495 bp, Homo sapiens
  ENST00000495354
ggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggctggacaacattgggcagagatgtggggaaagccaactctgggaagcaaacacttggcgaggccctttctgggggtgcgatctgcataccttcttgcccgggtgtggacagcggtcaggagggaggcagagcaactccagccttttccctccccttctgcgtttcgtgtacagtccctgcatactccattggtatgtaag

SEQ ID NO: 1313 - DNA, 732 bp, Homo sapiens
  ENST00000488156
ctgtgaattttaaaaggtgtagcaggccgggcgcggtgagtcaccgcgccaggcccgatcataaacacttttaaagtgaagaggctttccgcttcctcaacataaggagtaaatctttaatgctgcttctaggaaaaaaagtacaagaaaagcaagacttcctccttgccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcgtaccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatgg

SEQ ID NO: 1314 - DNA, 2045 bp, Homo sapiens
  ENST00000261783
gcgaagaaggtgtgccgggggctggttggaggcgcgggcggcggggccaatgtggcggtgacgtcacggggcgggcggacgctggcgcgggtaggtaagagcagcggcgggcggtggcgctcactcccggcttccaaccgcgcggagcctctgccttggagattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtaccacaactcccaggattttcctggatcaaaccttgtatctcttctgcaagtattgtgtatattggtctgagagacgtggaccctcctgaacattttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatcttgttgaagtcaatcctcagttggccacctcagaggaagaggcgaagactacagctaacctggcagtagatgtgattgcttcaagctttggtcagacaagagaaggagggcatattgtctatgaccaacttcctactcccagttcaccagatgaatcagaaaatcaagcacgtgtgagaatttaggagacactgtgcactgacatgtttcacaacaggcattccagaattatgaggcattgaggggatagatgaatactaaatggttgtctgggtcaatactgccttaatgagaacatttacacattctcacaattgtaaagtttcccctctattttggtgaccaatactactgtaaatgtatttggttttttgcagttcacagggtattaatatgctacagtactatgtaaatttaaagaagtcataaacagcatttattaccttggtatatcatactggtcttgttgctgttgttccttcacatttaagtggtttttcatctttcctccctcctcccacagcctggctatacagtgcatccttgaactgtcagcccacagcagcaatatgcttattctatccacatccctaacatcatgcattcacaaggtcaaagttctggtccacaaacccttccctatagaagttcaatggctgcgaaagaatttgtagtaaaccaggcctcccaggatggcgagctccagtaagatgataatggaaagcagcagcttgttggttgtcactctacaaagagaagcaaagtggggagtagtcagaagtttggataaccttccttctaaacattttggggttagacctgggaccacggctggatactctgaggctgtatgtttgatcacacagccacttagcaggaagtactcataaggttctttagctgtcacttagggataacactgtctacctcacagaaatgttaaactgagacaataaaaaccaaagcataaaaatggattctgaaa

SEQ ID NO: 1315 - DNA, 836 bp, Homo sapiens
  ENST00000557120
cgcgcggagcctctgccttggagattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtaccacaactcccaggattttcctggatcaaaccttgtatctcttctgcaagtattgtgtatattggtctgagagacgtggaccctcctgaacagtaagttgatgcatttggctgaagtttagggcctgtcctagccaattatgttctatttgaaaggctgatgcttaacttggtctattgcaggtcactacaacaaacccaccctctcccccaaatacatatttgttaaaaatgctctttaaactaaggactcctccctttatatctcat

SEQ ID NO: 1316 - DNA, 457 bp, Homo sapiens
  ENST00000556491
gtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacaggtaccacaactcccaggattttcctggatcaaaccttgtatctcttctgcaagtattgtgtatattggtctgagagacgtggaccctcctgaacagt

SEQ ID NO: 1317 - DNA, 627 bp, Homo sapiens
  ENST00000557319
gttcctcagctgcccttctgaaacatttccaccttgtgtcacttctccttcccagatcaagtgtgtcctgtgttgctctaaacttaccctgtgggtggcagaagaaagcagattgcatacccacggacgcacatgataatgatcttggtgagaacaagaattcttgattaatcctgtccatttctccctttcataggtaccacaactcccaggattttcctggatcaaaccttgtatctcttctgcaagtattgtgtatattggtctgagagacgtggaccctcctgaacattttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatcttgttgaagtcaatcctcagttggccacctcagaggaagaggcgaagactacagctaacctggcagtagatgt

SEQ ID NO: 1318 - DNA, 1559 bp, Homo sapiens
  ENST00000510379
gagctcggcgggggctgccgggattggggcgccgcagctagcgctggtctcggtggcagctcctccgcgccgcaggactcggctctacgggacatgtccgtgccgcgctcgccgcgcgcccgggcctgctagctcctctgtgctccctgaacgcgcggcgccgcacctggcagcggcctcggagctcggctcgggcaggagcgcgcggccgtgcgcaccgcgcagcgaccgctgccgtcatggggctgcagcccctggagttcagcgactgctacctcgacagcccgtggttccgggagaggatccgcgctcacgaagcggaactcgagaggaccaacaagttcatcaaagagctcattaaggacgggaagaacctcatcgctgcgacgaaaagtctgtcagtggcccagcggaagtttgctcattcactcagagactttaagtttgagtttatcggtgatgctgtgacagatgatgaacgatgcatagatgcttccttacgtgaattttcaaattttttgaagaatctggaggaacagagagaaattatggcattaagtgtaactgaaaccctgattaaacccttggaaaaattcagaaaagagcaacttggagctgtaaaggaagaaaaaaagaagtttgacaaagagacagaaaagaattatagtctaattgataaacatttgaatttatcagcaaaaaagaaagactcacatttacaagaggtataattttttatttttctgttacgttttcaaaatttgataagcaatacatgtcttttaaaaatgtgctttaatttggataacttttcatctggcattatatagagataacaaaaagtgaacaggtattgtcataaattaagaaaaaagtccttgtgaaacaagaaaaaataatgaatacatcttatagtgattaatgagctatggattcatagtagtaaaatttttgtttctgagcattattttataggaacataactttaaaccagcattagtgaagaacagatatattatttgcaggaatagatcaattaattggcttttgggagttcttgaagaaatgaattgaatttaataagctcatataccattatgcgtttatgtgaaggcagcattaatcttatttaatgctgaggattcaggaggttcaactttgttggaaagagagcatctgttttacttgtattaatagactcatttattttggaggcagccatatgtaagcaggaaggaatttatattttatttttcattttctctttgtttacttctaaatcccctgccatttgtttctctcactcacacacttggatggaaactcagttgtttacaattcaaaacaaaatgcttttattaaaaataatgctgtttgccattgttaggatttagtctcatcccacaaaattgtatttttttttcttgtttttttaacacataaggaatctggacattatgtactactgtcataaacacttattgaagtattatcaaaatgacacagtattaagtcttgtgtaaacctggattatatttaaatgttagctatttagttac

SEQ ID NO: 1319 - DNA, 3299 bp, Homo sapiens
  ENST00000336498
gagctcggcgggggctgccgggattggggcgccgcagctagcgctggtctcggtggcagctcctccgcgccgcaggactcggctctacgggacatgtccgtgccgcgctcgccgcgcgcccgggcctgctagctcctctgtgctccctgaacgcgcggcgccgcacctggcagcggcctcggagctcggctcgggcaggagcgcgcggccgtgcgcaccgcgcagcgaccgctgccgtcatggggctgcagcccctggagttcagcgactgctacctcgacagcccgtggttccgggagaggatccgcgctcacgaagcggaactcgagaggaccaacaagttcatcaaagagctcattaaggacgggaagaacctcatcgctgcgacgaaaagtctgtcagtggcccagcggaagtttgctcattcactcagagactttaagtttgagtttatcggtgatgctgtgacagatgatgaacgatgcatagatgcttccttacgtgaattttcaaattttttgaagaatctggaggaacagagagaaattatggcattaagtgtaactgaaaccctgattaaacccttggaaaaattcagaaaagagcaacttggagctgtaaaggaagaaaaaaagaagtttgacaaagagacagaaaagaattatagtctaattgataaacatttgaatttatcagcaaaaaagaaagactcacatttacaagaggcagatatccaagtagagcagaaccggcaacacttctatgaactgtctctcgagtatgtgtgtaagctgcaggaaatccaagaaagaaagaagtttgagtttgtggaacctatgctgtcattttttcaggggatgtttaccttctatcatcagggccatgaacttgccaaagacttcaatcactacaaaatggaactacagatcaacattcagaatacacggaatcgatttgaaggaacaaggtcagaagtggaagagctcatgaacaaaatcagacagaatcccaaggaccacaaacgagcaagtcagtttacagccgaaggctacctgtatgtccaggaaaaaaggcctgctccgtttggttccagttgggtcaaacactattgcatgtatcgaaaagcagcaaagaagttcaacatgatcccatttgagcacagatctggagggaaacttggggacggagaggtgttctttttgaaagaatgtaccaagaggcatactgactccattgacagaaggttttgttttgacatagaagctgctgatcggcctggcgtttccttgaccatgcaggcattttccgaagaggaaaggaagcagtggttggaagctctgggtggaaaggaagctctgtcccatagttttaatacagccatcatcccaagaccagaaggaaatgcacagttggataagatggggttcacaattatcagaaaatgcatcagtgccgttgaaacacgaggtataaatgaccaaggattgtacagagttgtgggggtgagttcaaaggtccagagacttctgagtatgttgatggatgtaaaaacatgcaatgaggtggacctggagaattctgcagattgggaagtgaagacaataacaagtgccttgaaacagtatttgaggagtcttccagagcctctcatgacctatgagttacatggagatttcattgttccagccaaaagcggcagcccagaatctcgtgttaatgcgatccatttcttggtacacaaactgccagagaagaataaagagatgttggatattttggtgaaacacttaacaaatgtttcaaatcactccaagcagaacctgatgactgtggcaaacttaggagtggtgtttggaccaactctgatgaggccacaggaagaaactgtcgctgccctcatggacttgaagtttcagaatattgttgtggaaatcttaattgaaaaccatgaaaagatttttcggacgccgcccgatactacattccctgagcccacctgcctgtcagcatcacccccaaatgcgccaccaaggcagtcgaagagacaaggccagagaaccaagaggcccgtggccgtctacaatctttgtctggagctggaagatggtgacaatccttacccttccaaggaggacacccctaccagcagtctggactcactttcctccccgtctcccgtgactacagctgtccctgggcctcctggaccagacaaaaaccaccttctggcagatggagggagctttggagactgggcatccactatcccaggccagacccgatcgtctatggtccagtggcttaacccacagtctccaaccacaacaagctccaactcagctgtgacacctctttcacccgggtcgtcccctttccccttttctcctcctgctactgtagcggacaagccacctgaaagcatccgcagtcggaaggctcgagccgtgtatccgtgtgaagcagaacacagctcggaattatcttttgaaataggagcaatttttgaggatgtacaaacctccagggaacctggctggctagaagggactctgaacggcaagagggggctgattccacagaactacgtcaagctgctgtagctcctggcctcagagcccctgctgaccctggcacccagggacctgcctgggggcagagagctgtcttcctcctccgaggctctgggctgcacccacaggtacctccacacttgggagttaccatcatcacagtcagccctgggggtggggggtggtgggcagggatgggacgcaccacacagaactgtgattgtggatcaggaggggaatgtcaggattcgcaaaatggacttttcatttgtcaagtattgggacttgtgatttttaattatccagcatatagaatgagagggagggcagccttctgccacctgtgtcgcctccactggcagtcacgccaccagagccaccctggctccctctcctccctgagcacctgctgctgcgattttaaagggaactgtactactcgcagtgataggtttgcagagtgtgtgcttggctgtggcagcctagcttggagaagctgctgttggtgcaagggagatggtctcaagtcagagggaagcagagacgcgcgtctcaagcctgcccttcctagacggccacctgcaggaccccacactcactgcactggcagcgtgcactggcgtatttgtaacaggcttctcggtgctcctcacccgtgtgctgttttccaaacaccacctttttgcctcaaggtctctgtaaatgaaataaactgtaatttactatttg

SEQ ID NO: 1320 - DNA, 8188 bp, Homo sapiens
  ENST00000506054
gatgtctcttttccagccagaaatctctgtgtctggtgatgcctttgcccaagttttgctctggcccgctgggcttgttctgcctgctcttcctggcaggctgcactcggcttgtgctactggcctggatctcatgcctgccaagggcgagccaggcacggagtggcgaggagttcgtgagtgagttcagggtcatccggccactgtgcacagccgggcatgccgactgtggtggggcaggcagctccaggcacaggcactggctccgtgcaaggctgtggctggaccaggcatactgcaggtcgcttccattgtgggcactgggaacacggtggcacccggaaacttggagacaccaggaaccgcagagccccaaagaggatgtcacagccctggcttagggagcccctaggtctgggctccccgaagggccgcagctcttctctccttctcgtcgcccacaatgtagtgagcaggggagggggaggatcacccctgtttgtgttacagctctttcagtctggccattccttgggtcccaagttcttgtcccacatccaagaggaatgaggtatggagacaactggagggtgagcaaggtacaggggaacttcattgagcaacagaacagttctcaggagacctgaagtgagtagcctttttctgcaggcaggtcgacgtaatgagtgtccagctctcactggagaggagacctgtagtgcatagctcctttccacaggcaggtcatcctgactagtggaggagacccccagagggttgctccttccaacagctggtagtccccatgtctttctgagtctggctgagtccagagtttttctgggctcagaagggaggaagtgtgctgattggcccatgcgcagccatgagtgggcctggaaaaagcaccgtaagttttcatcccaggctgcagactccacctagaactggcagcccagcggctcccaggcttcaggccatccctggcttgaagctggggtttcaccagggacctgtctgtcccttcccacctaggaacctgtctcccgcagctgtcaacatgtcatccatggcgcccaaggtatttgtgccaagaggtgcctgcaggcccctgttaagctgctctcagccccctggcctccctcctgtgcttgttggcatccaaagtccagagggggccgagctggaggttggggttaccaggggcgctggcatgtcagaaccaccctgtgtgcatgcatacccggctgggtggcaacagtacctgggcttggctacaactttgctccacactgcatcaggcgccgggagccgggagaggccagggagcaggagcaggcacttcttgagcctgctggtggggcagtgggccttcgccggcccccaagagcacagggatgccctggtccagagctgtggctgcacggctgcagctgtgtctgggagcatggggctcctgccctgataactctgtagaagttggggctcctgcctgtttctggcccccgcgggcaccatggagtgcgcagccctggctgcactttgccctctgcagctggtgtcctcacagcggctgctccagactggccgctgctgccatcattgccagtaatcccagggattctggtgatttaatcacagagcatgtggcacaacagttctggattttcagaacattaagggggtggtgatagaggttgactggtaatgcaagggtaattacagtagcaagaacaaccaggagagagaatttactaaaagataaaatcaaattgataaatctgatgctggtataaatttcttcaagagcctttgcagtaataacaaatgaggaaatcacccttcttatgtctttattaaatagtcaacaaaattacagtgtttttgctgggagatgtgccaactaactgctgatggctgaactatcaaactctggttattggaggcacaaaaatatgattcagatgagtgttaggtagaaattctcattttagcttagtaatatatattaaagtatttgctgaaatggtttttattacattttgaaatgtgtttcaaatgtgttaaatgcttttcaaaaacaacacatttttggttataaaacgtgaataaaatttcaataaaatgtatgattttattttaaagtctatggcccagtggtattaagtacattcacattgttttgcaactgtcaccaccatgcatctccagggctttttaaaaaatcttcccagactgcagctctgtacctattaacaataactctccattctcccctgctccagctcctggcagccgtcgttctgctttcagtttctatgaatttaactactctaggtgtctcatgtgagtgggatcatatagtatctgtccctttgtgactagtttatttcacttagcctgatgtcctcaaggtttatccatgttgtagtatgtatcagaatttccttcctgtctaaggctgaataatattctgttatacatatggattggctacattttatttactcatccatccatccatgggcattggggtcactttgccccctgctgctatgaacaggggtgtacacatatctgttcgagtctctgctttcagttcttttgggtatatgcccagctgtagaattgctgggtcatgtggtaatactatttttcatttgagggaaaaatttattttaattttttgctgggagttgtgcctgttaactgctggtggctgaactattgaattctggttaatgaagccacaaaaatatgattttgaggagtgttaggtagaaatgttcatgttagcttagtaacacgttatgtttcaatattattttacttaaagcactatttttcacagtgcttgtaccatcttgcattcccactaatgatgcacaagggtttcagtttcttgacatcctcaccaacaccactacttttcttttttgtacagtagccaccctagtgagtgtgaggtggcatctccttgtgagtttgatttgcatcctaatgatgagcgatgttgagtgtcttttcacatgcttattggccttttgtatatcctctctggagaaatgcccagataaatatttttaagagtaaaattagctaagttaggaaaaatatcacatgatacctagtaagaatggtttcttggacatgagttctctctccactattctctgtggagtcctgctcttctcccagttcctttctagttaggcaagctaagctggaagctttttttggaatagcgtcctgaccagctggtgcccccttctctcccaggggatcagacgttctgagggccgcagatgggcgtccagccctggcccgcctttgagagccgggttcttgagatgctgccatggctggctccttctcacttgccgccatcactccctgagcgctgaggtgctgggccctttctcaggcagactttattcctagaggatttgttcatcgaaatgtttgttgattgtgattgcatgtggttcagccttggggcatcagttgtggttggggtgagtttttcaagaagagaagtccctttgatcttcagttcttgggggtcaacttcaacaaacagagtaggagtcacaagctttttctgcaaagaaactgatagtaaatattttagacttctgtggaccataaagttcctgttgcacctgctcaattctgctgttgcagcaggaaagtagctgcagacaatacataaatgaattgtcgtacctgtgttgcaatactttatttacaaaatcaggcagcacaccgtattttggcccatggaccacagtgtgatgacctctgatgtagcgtttcacttttcaccatctccagtttgactaacctctgtgattttaacataggcagatatccaagtagagcagaaccggcaacacttctatgaactgtctctcgagtatgtgtgtaagctgcaggaaatccaagaaagaaagaagtttgagtttgtggaacctgtgagtattgccaagttgtttgctggtggatttttgcaatgtaagataagtatttattttcctagatctgatttatggtttatagttactagaggccatagtgcataaacatgaaagagacatattaaaaagggcagacacagatagccatgaagtcaaggaattgcctctaaatcagtggttctcagctgtatttgcactgataatacacgtaatattcccattgctacatgatctcaaggaaggcaaccatgtgcaatttctgccaccttagcctatagctctatcttttaaaaatttctctgaaataatttatactagaatgagtgaacatgggttgtttataccggttcaaactttggtactttaaacaatcgtttgtaacatgacttcaaacacaattcacaatgcttatggcaatctaagtttagaagcaggatatggaacatttgagacaattttgtgagttactctaacatttctttttacttatattagaaacacatgatttttgtttgtgattatatagatgttttctagtagcttcagttgtttatatatgaagatgtatgcacatgaatgtatatatcataatgtaaaggatatttcatgtggatttcagcaaaaaaacactggatctcattctcaggattcattttaattttaatatcgacttattgaatggtttctttttcttaaacagctttattaagataatattcacacagtatacaatttactcattgtgagtatggtttatagaaacaagaataaccaagtaatgattaaaaatgagcatttgtggagctatggtttagttggagcgatagtcattaacctaaaccattagagaaaaactcaacctcctcaaagctttctttttaatgtgaaataataataatggcctgcttttattgggcatttataatgctcagtctctgttcaagccattgttctaagtgttgtaccgaactcattattccacactataactcaatgaggagataaggaaatagaagtagagaaaggctgagtaatttgcctaaggtcccataacaggtcatggctgacgttgggaatggagcctgctgggtgtcagagccccagattcctaaccacccacggtgtggcatttggaagaaaatgaatctcaagatttccttaactgtctccccagatcacttctttttacttctagatttattgacttacatgtggagcagaggcaacagccctctaattcagagacaggttgggagttggtaggaaagtaaaggtttaattacgggtttgaggctgcccctggcaagtcatggaatatctttgtcaacaaaacacaggggttgcagtctgctggatgtggctggggagagcctggagctctttgattctgtgattttactttcttaaagattgtgtcaacctatagtgataagatttcaattacaaatattgggattctcctgactaaagaggacaaatggatgacttaataattcaatttttcctgcagaacatgccatataagctgtctaatggctgtgatatttaagggaaaaaagcatcattttctataaagaccaattaatagataatatgtacttgtgtttacttgaatattagtgacttccctttaatcagtttatttcagtggaataacagtgagatggcggggggaacacttggttgtttatatgattctttttttctcctgagtttttttgtgctaatatctcttttcttcctgtgtcttagatgctgtcattttttcaggggatgtttaccttctatcatcagggccatgaacttgccaaagacttcaatcactacaaaatggaactacagatcaacattcagaatacacggaatcgatttgaaggaacaaggtcagaagtggaagagctcatgaacaaaatcagacagaatcccaaggaccacaaacgagcaagtcagtttacagccgaaggctacctgtatgtccaggaaaaaaggcctgctccgtttggttccagttgggtcaaacactattgcatgtatcgaaaagcagcaaagaagttcaacatgatcccatttgagcacagatctggagggaaacttggggacggagaggtgttctttttgaaagaatgtaccaagaggcatactgactccattgacagaaggttttgttttgacatagaagctgctgatcggcctggcgtttccttgaccatgcaggcattttccgaagaggaaaggaagcagtggttggaagctctgggtggaaaggaagctctgtcccatagttttaatacagccatcatcccaagaccagaaggaaatgcacagttggataagatggggttcacaattatcagaaaatgcatcagtgccgttgaaacacgaggtataaatgaccaaggattgtacagagttgtgggggtgagttcaaaggtccagagacttctgagtatgttgatggatgtaaaaacatgcaatgaggtggacctggagaattctgcagattgggaagtgaagacaataacaagtgccttgaaacagtatttgaggagtcttccagagcctctcatgacctatgagttacatggagatttcattgttccagccaaaagcggcagcccagaatctcgtgttaatgcgatccatttcttggtacacaaactgccagagaagaataaagagatgttggatattttggtgaaacacttaacaaatgtttcaaatcactccaagcagaacctgatgactgtggcaaacttaggagtggtgtttggaccaactctgatgaggccacaggaagaaactgtcgctgccctcatggacttgaagtttcagaatattgttgtggaaatcttaattgaaaaccatgaaaagatttttcggacgccgcccgatactacattccctgagcccacctgcctgtcagcatcacccccaaatgcgccaccaaggcagtcgaagagacaaggccagagaaccaagaggcccgtggccgtctacaatctttgtctggagctggaagatggtgacaatccttacccttccaaggaggacacccctaccagcagtctggactcactttcctccccgtctcccgtgactacagctgtccctgggcctcctggaccagacaaaaaccaccttctggcagatggagggagctttggagactgggcatccactatcccaggccagacccgatcgtctatggtccagtggcttaacccacagtctccaaccacaacaagctccaactcagctgtgacacctctttcacccgggtcgtcccctttccccttttctcctcctgctactgtagcggacaagccacctgaaagcatccgcagtcggaaggctcgagccgtgtatccgtgtgaagcagaacacagctcggaattatcttttgaaataggagcaatttttgaggatgtacaaacctccagggaacctggctggctagaagggactctgaacggcaagagggggctgattccacagaactacgtcaagctgctgtagctcctggcctcagagcccctgctgaccctggcacccagggacctgcctgggggcagagagctgtcttcctcctccgaggctctgggctgcacccacaggtacctccacacttgggagttaccatcatcacagtcagccctgggggtggggggtggtgggcagggatgggacgcaccacacagaactgtgattgtggatcaggaggggaatgtcaggattcgcaaaatggacttttcatttgtcaagtattgggacttgtgatttttaattatccagcatatagaatgagagggagggcagccttctgccacctgtgtcgcctccactggcagtcacgccaccagagccaccctggctccctctcctccctgagcacctgctgctgcgattttaaagggaactgtactactcgcagtgataggtttgcagagtgtgtgcttggctgtggcagcctagcttggagaagctgctgttggtgcaagggagatggtctcaagtcagagggaagcagagacgcgcgtctcaagcctgcccttcctagacggccacctgcaggaccccacactcactgcactggcagcgtgcactggcgtatttgtaacaggcttctcggtgctcctcacccgtgtgctgttttccaaacaccacctttttgcctcaaggtctctgtaaatgaaataaactgtaatttacta

SEQ ID NO: 1321 - DNA, 1934 bp, Homo sapiens
  ENST00000507661
atgtaccaagaggcatactgactccattgacagaaggttttgttttgacatagaagctgctgatcggcctggcgtttccttgaccatgcaggcattttccgaagaggaaaggaagcagtggttggaagctctgggtggaaaggaagctctgtcccatagttttaatacagccatcatcccaagaccagaaggaaatgcacagttggataagatggggttcacaattatcagaaaatgcatcagtgccgttgaaacacgaggtataaatgaccaaggattgtacagagttgtgggggtgagttcaaaggtccagagacttctgagtatgttgatggatgtaaaaacatgcaatgaggtggacctggagaattctgcagattgggaagtgaagacaataacaagtgccttgaaacagtatttgaggagtcttccagagcctctcatgacctatgagttacatggagatttcattgttccagccaaaagcggcagcccagaatctcgtgttaatgcgatccatttcttggtacacaaactgccagagaagaataaagagatgttggatattttggtgaaacacttaacaaatgtttcaaatcactccaagcagaacctgatgactgtggcaaacttaggagtggtgtttggaccaactctgatgaggccacaggaagaaactgtcgctgccctcatggacttgaagtttcagaatattgttgtggaaatcttaattgaaaaccatgaaaagatttttcggacgccgcccgatactacattccctgagcccacctgcctgtcagcatcacccccaaatgcgccaccaaggcagtcgaagagacaaggccagagaaccaagaggcccgtggccgtctacaatctttgtctggagctggaagatggtgacaatccttacccttccaaggaggacacccctaccagcagtctggactcactttcctccccgtctcccgtgactacagctgtccctgggcctcctggaccagacaaaaaccaccttctggcagatggagggagctttggagactgggcatccactatcatccgcagtcggaaggctcgagccgtgtatccgtgtgaagcagaacacagctcggaattatcttttgaaataggagcaatttttgaggatgtacaaacctccagggaacctggctggctagaagggactctgaacggcaagagggggctgattccacagaactacgtcaagctgctgtagctcctggcctcagagcccctgctgaccctggcacccagggacctgcctgggggcagagagctgtcttcctcctccgaggctctgggctgcacccacaggtacctccacacttgggagttaccatcatcacagtcagccctgggggtggggggtggtgggcagggatgggacgcaccacacagaactgtgattgtggatcaggaggggaatgtcaggattcgcaaaatggacttttcatttgtcaagtattgggacttgtgatttttaattatccagcatatagaatgagagggagggcagccttctgccacctgtgtcgcctccactggcagtcacgccaccagagccaccctggctccctctcctccctgagcacctgctgctgcgattttaaagggaactgtactactcgcagtgataggtttgcagagtgtgtgcttggctgtggcagcctagcttggagaagctgctgttggtgcaagggagatggtctcaagtcagagggaagcagagacgcgcgtctcaagcctgcccttcctagacggccacctgcaggaccccacactcactgcactggcagcgtgcactggcgtatttgtaacaggcttctcggtgctcctcacccgtgtgctgttttccaaacaccacctttttgcctcaaggtctctgtaaatgaaataaactgtaatttact

SEQ ID NO: 1322 - DNA, 2131 bp, Homo sapiens
  ENST00000506020
catgtgcatacaactgaaagtgccgcttgctataagccaaggctactgagtgatactgttaacgatgatgatgataatagctatacatgaattacattgtggatgttgaaataatatactatgtctaattcttccttactcccaacccatctcttattttttgctttgatctctactacagattttacgaagtgccagaagtgtctagtcatagaacatagcttatagtattttagagaaatcatatatataatgttttcctaggaaactgcaggattgtggtttgcccatttaaaaatggaagctttgtgagctagacaagaggacctttgatgatcaaggttttaattatttttttcttgtttgcttgctcactagatgtaaaaacatgcaatgaggtggacctggagaattctgcagattgggaagtgaagacaataacaagtgccttgaaacagtatttgaggagtcttccagagcctctcatgacctatgagttacatggagatttcattgttccagccaaaagcggcagcccagaatctcgtgttaatgcgatccatttcttggtacacaaactgccagagaagaataaagagatgttggatattttggtgaaacacttaacaaatgtttcaaatcactccaagcagaacctgatgactgtggcaaacttaggagtggtgtttggaccaactctgatgaggccacaggaagaaactgtcgctgccctcatggacttgaagtttcagaatattgttgtggaaatcttaattgaaaaccatgaaaagatttttcggacgccgcccgatactacattccctgagcccacctgcctgtcagcatcacccccaaatgcgccaccaaggcagtcgaagagacaaggccagagaaccaagaggcccgtggccgtctacaatctttgtctggagctggaagatggtgacaatccttacccttccaaggaggacacccctaccagcagtctggactcactttcctccccgtctcccgtgactacagctgtccctgggcctcctggaccagacaaaaaccaccttctggcagatggagggagctttggagactgggcatccactatcccaggccagacccgatcgtctatggtccagtggcttaacccacagtctccaaccacaacaagctccaactcagctgtgacacctctttcacccgggtcgtcccctttccccttttctcctcctgctactgtagcggacaagccacctgaaagcatccgcagtcggaaggctcgagccgtgtatccgtgtgaagcagaacacagctcggaattatcttttgaaataggagcaatttttgaggatgtacaaacctccagggaacctggctggctagaagggactctgaacggcaagagggggctgattccacagaactacgtcaagctgctgtagctcctggcctcagagcccctgctgaccctggcacccagggacctgcctgggggcagagagctgtcttcctcctccgaggctctgggctgcacccacaggtacctccacacttgggagttaccatcatcacagtcagccctgggggtggggggtggtgggcagggatgggacgcaccacacagaactgtgattgtggatcaggaggggaatgtcaggattcgcaaaatggacttttcatttgtcaagtattgggacttgtgatttttaattatccagcatatagaatgagagggagggcagccttctgccacctgtgtcgcctccactggcagtcacgccaccagagccaccctggctccctctcctccctgagcacctgctgctgcgattttaaagggaactgtactactcgcagtgataggtttgcagagtgtgtgcttggctgtggcagcctagcttggagaagctgctgttggtgcaagggagatggtctcaagtcagagggaagcagagacgcgcgtctcaagcctgcccttcctagacggccacctgcaggaccccacactcactgcactggcagcgtgcactggcgtatttgtaacaggcttctcggtgctcctcacccgtgtgctgttttccaaacaccacctttttgcctcaaggtctctgtaaatgaaataaactgtaatttacta

SEQ ID NO: 1323 - DNA, 645 bp, Homo sapiens
  ENST00000513548
tttaaatttaatcagagattttattttggaatcttctgttaaaaaaataaaaggctatgacctcttcccttcattggaaggaatggattttgggctctagcctgtcttgaatgaactccaaatcaaatgttgtggtgctggtttactggagtaacacacaggtttctgttcatggtaaataattcctgtcctttatgctttgttggaagatttttcggacgccgcccgatactacattccctgagcccacctgcctgtcagcatcacccccaaatgcgccaccaaggcagtcgaagagacaaggccagagaaccaagaggcccgtggccgtctacaatctttgtctggagctggaagatggtgacaatccttacccttccaaggaggacacccctaccagcagtctggactcactttcctccccgtctcccgtgactacagctgtccctgggcctcctggaccagacaaaaaccaccttctggcagatggagggagctttggagactgggcatccactatgccagacccgatcgtctatggtccagtggcttaacccacagtctccaaccacaacaagctccaactcagctgtgacacctctttcacccgggtcgtcccctttccccttttctcctcctgctact

SEQ ID NO: 1324 - DNA, 627 bp, Homo sapiens
  ENST00000510076
gggaagcagtaggaaccttagctgcttggaatggaatggttgattatccagaatgtttgggatatgtggaatgtatcaacacgaggcacagtggtgtactgtcagtaatgcagcatttgctgacgattgttttttagaaagcaagttgcctcatttagaatagatttctatatgcgtgtgatatgtactcttcagagacagagactcctggtagtgtcagaaaacaaacaacaacaacaaaaccccacatggaacagaattagactttgtggagaaattttgttcttggaatagaagcaagatcattcctccatcaccataacatacatgcagttttgccaagagaatgtggaacgtagctgccctgccccaggcctgtctcatgttggcacaccatatggctgaaggggagggtgcgatgtacaaacctccagggaacctggctggctagaagggactctgaacggcaagagggggctgattccacagaactacgtcaagctgctgtagctcctggcctcagagcccctgctgaccctggcacccagggacctgcctgggggcagagagctgtcttcctcctccgaggctctgggctgcacccacagcatatagaatgagagggag

SEQ ID NO: 1325 - DNA, 2968 bp, Homo sapiens
  ENST00000409869
attgaacaaagtattttgaggtgcatttgtgtgtgcttgatacttgctccttttgattcaggtcagaatattaaatataagctcagtttctacaactggtttggcagaaatcaaatccgagtttgtctacagtgattcagaggggaccaggcctttcgcgatggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctatatccagacacagaaggaatcattcacagcatatcttgaaagatgtcattcctccattggaacaactgatggttgaaaaagaaggttatctgcaaaaagctaaaattgcagatggaggaaagaaactaaggaaaaactggtctacttcctggattgttctttctagtcgaagaattgaattttacaaagaatccaagcaacaggctctgtccaatatgagcttctgcttgatgtgttcaggaggcacctgaccatgttcatgggatttggcaaatctccatttttggttaaacaaaacccatttgatggattgcatcatagagaagaagctctgcaatttagaacatccattcatttattctctcaacagttaacaactcctaccaggtgtcatataatttttttctttttgttttgttttgtttttacattaggggcaacagaaatattcaaatgaatagtatatgatccctgctcttaaagtactcacaatatggtaaaagagacataattttgtataggtttattataataaaaccatgactaaagtgttaaaaaatattagacaacatgccatggaaccatagatttagctataggtagtctttttccagagaaactattgttgcaagtcatgttcagcttaggtatctctccttttgttcaaatattactgtttgatattattatatcaaatattattgagcatctcttatgtttaagtcactacgataggtgttctgaaagataaaaaatgaaccagactgaaacaaatagaaagtatggccttagattgagtatagtgaagaaatggatgttggtagttgtcctaaaatggcatgaacagagacatggcgtcgttttatgataactcaagagaagagtgtgattgcttccatttggacaggatttgaaatatattcatggaggaagtgacatttgagcacatttctgaaggatgtataggattttgatgtaaaagggggcaaaagatattttatgtactaataagagagtaattaatagtgaactatggaaaattctttttttgttgtttattttacagatgtatattgatctcttgccttcttccatgcactgtgtactagtcactgttcttgaaatgtttgaatgggggttccctgaggcctggagtgaatatttcctagtccagagtattttgtgtttcttctctaagttgcctgggagtgaggaacagctttagactaagttgcggaacagcattgtggaacagcaaacagtgtaatttggttagaaagtcagtgtggaaccggtttaggaaagactttgaacaggattgggagaagagatcatttcattctgtaggtaatgtggggtttttgtaaccaatatgaaatattctcaaattaagagagactcagagttttcagagacatgtttagggaactgatatatatatcagttgtctataaaattaagtctctcttaattttgtgtatatataacttaaaaacacatgcaggacttggtaaattatccgagagacatgttctaaaaatttatgcaaatagatgtgagcaataaggcctgagctcttacgacagagaaaattgtaaaacggctgtgtgtcatcattttggctcaatgcatttagtaaatcacaggacatcttttcactgacaaaatattttgatattctcatatgtctctgacctccaacagtatggccatttctaaagacgttctagtgcaaagagaacaagcagagctatccatctaaggagagcgaaaaacatgctgtcccaagaactaggtgtgtcaccatctcagtgagcacccgttgcaaacctactggtgcttccatctgactccagaacatctgtttagtgtcacaccctacttaaacaaatgcattgtgtgaagtctttccaccaacaatcagacgctgtggaactcattgtcaccaattgggtggatgagagccaccgtttctattatattcatcacacactgctcagaaaatttagtgtcacttttgatataaattcaaaaacattgtaaacattttagggaatattttccccctaaaatggtgtggttctaaagccagtatattcagtagaaagcctatatgttggttgtgtaagggacttttttgttactcttatgttttttattttacattgtactaatatgtatttttaatcagagccaacaactggcaatttttactttttaaaaattatatttttgggttttacatttaagtctttaatccatcttgagttaatttttgtatatggtgtaaggaaggggtccagtttcaattttctgcatatggttacccagttccccacatttattaaataaactataaaaactctagaatgaaatctaggcaataccattcaggacataggcacagacaaagattttatgatgaaaatgccaaaagcaattgtaataaaagcaaatggtgacaaatggggtctaattaaactaaagagcttccgcacagcaaaagtaactatcatcagagtgaacagacaactttcagaatgggagacaatttttgcaatctattcagctgacaaaattctaatatccagagtctataaggaacttaaacaaatgtacaagaaa

SEQ ID NO: 1326 - DNA, 1775 bp, Homo sapiens
  ENST00000295095
gcctttttcttcccccagtactgaaattaagcagcatccaacacaggcctactcttacgacatgtgactttactgttttccgtttttgttgaaagagtcattaacagttaggagttgatggcagtttcaataacaggtcattgccgagaaaaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctatatccagacacagaaggaatcattcacagcatatcttgaaagatgtcattcctccattggaacaactgatggttgaaaaagaaggttatctgcaaaaagctaaaattgcagatggaggaaagaaactaaggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattacccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtctagatgttgatggaatatatcgagttagtggcaatctggcaacaatacagaagttaagatttattgtcaaccaagaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaata

SEQ ID NO: 1327 - DNA, 1086 bp, Homo sapiens
  ENST00000552641
attaacagttaggagttgatggcagtttcaataacaggtcattgccgagaaaaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctatatccagacacagaaggaatcattcacagcatatcttgaaagatgtcattcctccattggaacaactgatggttgaaaaagaaggttatctgcaaaaagctaaaattgcagatggaggaaagaaactaaggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaagtgagtattttctttgacttgctcattttaagtttgtctaaatgcagtgcttatgaaatataaatgcattgaaatgagatttaagccaaactcatcatactcatggaagattcgtagccatttcctggccagggatttgtgcactggagggcagtctgggcactttgctcacatcattgttggtaatgccttttgagaaaataattgttccaaggtcatggtctctgcttacagcaaacctctgaatctctgagtaatagccatggtgttcagatcagtgattgattttgagagtgggaaatgtcaagcatctcc

SEQ ID NO: 1328 - DNA, 521 bp, Homo sapiens
  ENST00000460776
aacagctgtctggcctgagccaacatacttacgaccaaggaaaagtgccatccttcaatcctgctgagttggattaaccttcagaactaaatctgctttttcggcagcagaagatatccagacacagaaggaatcattcacagcatatcttgaaagatgtcattcctccattggaacaactgatggttgaaaaagaaggttatctgcaaaaagctaaaattgcagatggaggaaagaaactaaggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattg

SEQ ID NO: 1329 - DNA, 337 bp, Homo sapiens
  ENST00000474474
tttctagtaagattcaacattatgaaaatattttgaattaagcaatgacacatgaggctggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattg

SEQ ID NO: 1330 - DNA, 434 bp, Homo sapiens
  ENST00000469117
gtggttttcctgcccagccctccgccactgggctgtggagcccgctgctgctggtgcattcttgtacgtgaggtgtttctcctgtccagcctggcaccactggcctctttccccgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaa

SEQ ID NO: 1331 - DNA, 627 bp, Homo sapiens
  ENST00000548800
gcatttttctgcgggttctgacttaagtgtgtactgtctgcagttctctgaacttcctggcttgtttctccttaagttggagtaattcagctctagccctactctgacttaatcgttctattattaaaacaataatgtatttgttatgacgtgaaaaacagtttatagagagcggttcaaaatgctcccagttcccagaaagacaattactggaatacaagaaaatatttcattttattaaactgtgttttttaaaaaaggatttttacatgtaagagatctatcttacatagtttctttacctgtctatttctttttcttttttttttttttgcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaagtgagtattttctttgacttgctcattttaagtttgtctaaatgcagtgcttatgaaatat

SEQ ID NO: 1332 - DNA, 540 bp, Homo sapiens
  ENST00000548242
atttttctgcgggttctgacttaaatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattacccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtaacatgattaacgttggaagaactctgaaaccccgaaaacaagagaagacgtgtgaacctgtt

SEQ ID NO: 1333 - DNA, 623 bp, Homo sapiens
  ENST00000548929
aacttcctggcttgtttctccttaagttggagtaattcagctctagccctactctgacttaatcgttctattattaaaacaataatgtatttgttatgacgtgaaaaacagtttatagagagcggttcaaaatgctcccagttcccagaaagacaattactggaatacaagaaaatatttcattttattaaactgtgttttttaaaaaaggatttttacatgtaagagatctatcttacatagtttctttacctgtctatttctttttcttttttttttttttgcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattacccgaagaccttccctgaaaactctgcaagaa

SEQ ID NO: 1334 - DNA, 353 bp, Homo sapiens
  ENST00000552289
aaatcttcagtgttcagactgcatcacagtgcttccgatacaagcgacaaaaatcgagttaaaagcagattaaagaagtttattacccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtgggtgactgaatgtgcagcagttccccccattactgcaccctctacacaaccaatactcaagttagcagtgccacctgatttgtctgagaagccatgcaattaaaacttgacttgtgtt

SEQ ID NO: 1335 - DNA, 842 bp, Homo sapiens
  ENST00000549436
gctctcatctgcacaaagtgtgtgaacgtgaaaattccacagttccgtggtttgtaaagcaatgcattgaagctgttgagaaaagaggtctagatgttgatggaatatatcgagttagtggcaatctggcaacaatacagaagttaagatttattgtcaaccaagaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagtaagttgtaaggatttctggatgtgtcattttatagtcatttcctaaatgggcaatattgaatttcacatctctaaggcaagagtttccaaatgcgtacatctcgtattttcccttgtagctgaactaggtctttctgcagaagctggagaatgtgttagggataggaaggacaatctacaaaaggaacttctgaaataacttatttttcaaggccctttcaactagtatatgtttgctgattgcttgtcagaaccatcgcctggaccctgggatgggtcatcttgactttgttatctaacataatgaaagaacatgaaatgattcagacatggattcaaaactcagccccaccatgtaccacgtgctggggccacaaataagttacttaaaccctctgcaaccaatttcctcatctgtaaaatgttggctcaga

SEQ ID NO: 1336 - DNA, 345 bp, Homo sapiens
  ENST00000419455
gtctagatgttgatggaatatatcgagttagtggcaatctggcaacaatacagaagttaagatttattgtcaaccaagtcgtttctggaataccagcccttctatcagaactggatggagacctgtggacacccctagtaagctgcagatttttcacagtggtcatttgacctccagagcaagccaataatttgtcacttcattaaactgaagagaagctgaatttggacgacagccagtgggaggacatccacgttgtcaccggagcactgaagatgtttttccgggagctgcctgagccgctcttcccttacagtttctttgagcagtttgtggaagcgatca

SEQ ID NO: 1337 - DNA, 537 bp, Homo sapiens
  ENST00000549060
agtttgtttagtgagggtcagggaatgtaatgaagtgccaaaaattccacttgacctacgtactctacagtcaacagaaaagcactccatttttgcagagctctgagttaaatgcactcctcaaagcagatcagctatcaactgggaaagcttaatgcggcacagttggactagaaggatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgac

SEQ ID NO: 1338 - DNA, 6189 bp, Homo sapiens
  ENST00000260283
gaggcgcgtgtccgtgcactagaggcccccgtgcgtgacacaggccgatgagctcctgcgggctgcacccacgcggagtcacagaccgaaaagcccgcggtgtcgagcgcaggcggaggtacatggccccgacgggaggcgcgcggcgagcacccggagctcggctccctgcctgagcacggcagccgcgcctccgcccgcgcgtcctcgcccctccggccggcagcccgcggacatgatcgtgtagcctcctcctgggctgggatttgtttgaagattttcttcatggaagcgatgtccccccagcaggagactctagggggacagccggggcgctcctcttccctgacaggagtgtctcggctcgcgggaggcagctgcaccaagaagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcagaattaaccatcc

SEQ ID NO: 1339 - DNA, 2623 bp, Homo sapiens
  ENST00000529591
gttttctgcccccacattcttggaaatgctctacatttttggaaacacctacagtcaaaatgagctttaagcagagcttttgaccttagcagtatcttctgcagacctgtgtcaggctctcacctcccaaaggattggaatgcaccagagctaggggtcgagacaaggccccagcctgtatctcaggctgaaacgtgaaaaccaagttaaggaaaatatggtgaagaagattcttgcatacccctactccagctgagtgcccaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacagaaactgctgctaacttttaaagttgtttggttttcaaggcactgataatggatatgtatgaagtccatgctgtctgttaaataaaatgccattctgcagaattaaccatc

SEQ ID NO: 1340 - DNA, 6180 bp, Homo sapiens
  ENST00000524756
acagcagcgcgctaggcggacgccgcgggaatttgacgctcgaggctcgcggcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccgccggttctgcagcccggctcctccctcagtctaggcgcgcgggctgtagtgggcgatcgcctttccccgacccctcgccgtgcccctgggcctcccgaagtggcctgggcgagcactgactgccctttggcggtgtcagccccaaagtcagggccggcgatgtctgcccgggagcggcagccggcgctgaagaagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcag

SEQ ID NO: 1341 - DNA, 5880 bp, Homo sapiens
  ENST00000528829
gaggcgcgtgtccgtgcactagaggcccccgtgcgtgacacaggccgatgagctcctgcgggctgcacccacgcggagtcacagaccgaaaagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcag

SEQ ID NO: 1342 - DNA, 6066 bp, Homo sapiens
  ENST00000533353
gtagccttctcaatagcttagccaaatttcggcgtcctcgctctgtctgcattttccttcattgctctttcacgtttggaatgcccccgtctctgcagcctgcagacagcggaaaccgcgggtgcaaatgtgcaggggccgctgacatgaccggctgcagaagcccactcagggttacccgaacaggctagcgttcgggattgcacaagagccaaatttgcctgtgaaataaagatagtagtatctacccggatgacattttggattataataaataagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcag

SEQ ID NO: 1343 - DNA, 5998 bp, Homo sapiens
  ENST00000527598
gtagccttctcaatagcttagccaaatttcggcgtcctcgctctgtctgcattttccttcattgctctttcacgtttggaatgcccccgtctctgcagcctgcagacagcggaaaccgcgggtgcaaatgtgcaggggccgctgacatgaccggctgcagaagcccactcagggttacccgaacaggctagcgttcgggattgcacaagagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcag

SEQ ID NO: 1344 - DNA, 2751 bp, Homo sapiens
  ENST00000249601
ggactgccccgccctggtccagtgattgatcagcagtgattactgaggctttaatggtccgcttggatgggaattaattctgggatggataaataatgcatcgaggtttatgtagtccaaggcgagccgtccgtccggagccaggagaggtagccgagggagcctgacgggtgacgccagcggccacggggccccgaacgagcaggacatgaggggcgactaggcgcgaggacgagcaaaagcaagtggatgacagcatgaacggccctgcggggctggccggacggctgcaagaacatgctgagcccaaagatcaggcaggccaggagggcccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccagggatttatttctctacaagggacacaggtgactgaacttcctcctggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccgctgggcggagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagtagcgcttagcccttacccaggaaatatccttcatggccacagaaatggagggcgcccaggatccaggcagccaccgggaacagtcagctttctttattaaatgtgctcacaaagcatg

SEQ ID NO: 1345 - DNA, 1951 bp, Homo sapiens
  ENST00000477708
atgtgtgtgcccccacacaggaaagatggctctattccctgtcccagagccctatgctcccagagtgtggacattcaggcatggcagttgtcagcagcacagaggggtgacgtggggcagccgagagagttctggcatctcaggtcccaggttccagttccaacctgccacctgctcaccgtgcagccttggtgcctgcttcctcaccccaccccagctggagggcgtgagcgcaggcacagtgcttcctccctgcttgcggctctgtgcctgaggaaggcggttctgcggccccatcctgctgtcctgcctggagttggagggtgtgtggtcctttcctctgggcggatgaaggctcccttgaggggcggcctggctctggggacagggccagctcccacgaagctgcagcttctccatgactggcagagcgagcctgggccgagtggctggcagcaaggcccttctccgcctctcttcccggcaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagtagcgcttagcccttacccaggaaatatccttcatggccacagaaatggagggcgcccaggatccaggcagccaccgggaacagtcagctttctttattaaatgtgctcacaaagca

SEQ ID NO: 1346 - DNA, 2107 bp, Homo sapiens
  ENST00000374170
cgcgggccggcggtcccgcgcaccctgcgcccagctgggcactgcccgtgggccggacctcggccgcgccgccccggggcgcaggcggcaggcggggagaggagccgagcggcggggccgcgggcggctgccatggggctgtgctgctgcaaggactggaggggacacctgcgagcgcccaaaggtggtgccggggagcgggagaaggtgccggccaaccccgaggcgctcctgctcatggccagctcccagcgtgacatggaggactgggtgcaggccatccgccgagtcatctgggccccgctgggcggagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacaggtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagtagcgcttagcccttacccaggaaatatccttcatggccacagaaatggagggcgcccaggatccaggcagccaccgggaacagtcagctttctttattaaatgtgctcacaaagca

SEQ ID NO: 1347 - DNA, 2380 bp, Homo sapiens
  ENST00000374172
gatgctccaaatatccctacaaagtactttattattcctgtttcacagacaaggaaactggggcacagacaggttgaacaatgttcctgtagctgagccaggatttgaacccagggatttatttctctacaagggacacaggtgactgaacttcctcctggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccgctgggcggaggtactgcccgtagatcgcatgcccaccctctagaacccttgcctccagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagtagcgcttagcccttacccaggaaatatccttcatggccacagaaatggagggcgcccaggatccaggcagccaccgggaacagtcagctttctttattaaatgtgctcacaaagca

SEQ ID NO: 1348 - DNA, 2340 bp, Homo sapiens
  ENST00000417247
aaaaggcctcagcctgatgcccacaggcagagcacacaggcagccgagtggccgcagccctgcagtggaggagtgcctcgtgcacctggtggttttctgcaccccaacaggtgtgtctggccactgctcctctcactgcagcccccgctgctccacaccatgcccttctggcccatcaggtgtctgaagaggagcaggcgtatgcccaggggtggtgccggggagcgggagaaggtgccggccaaccccgaggcgctcctgctcatggccagctcccagcgtgacatggaggactgggtgcaggccatccgccgagtcatctgggccccgctgggcggagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagtagcgcttagcccttacccaggaaatatccttcatggccacagaaatggagggcgcccaggatccaggcagccaccgggaacagtcagctttctttattaaatgtgctcacaaagc

SEQ ID NO: 1349 - DNA, 2595 bp, Homo sapiens
  ENST00000435790
acttctcaattctttgttctgtgaagtggttgtcactattgttcccattttacagatttgaggaactgataccccaagaccccgtgactttctcaaggccattccaagatccctagatgcacttacgcttaatgaactaattcttcacagcgaggcttcttgcttaaaatccaagaaaataccagataaagggcattctaaatatatttcttttctatagatgtggatctcctgttactggaaaacaggaattagcttgtctgcttgaggatgtggttggttctttataaaaaggatacagaagaaatttgcacagactgccagcttcattatgctgccgacagcttccagcaaaaggaggacgtttgcagccagatatttcacccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccagggatttatttctctacaagggacacaggtgactgaacttcctcctggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccgctgggcggagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggac

SEQ ID NO: 1350 - DNA, 2352 bp, Homo sapiens
  ENST00000417912
caggagaggtagccgagggagcctgacgggtgacgccagcggccacggggccccgaacgagcaggacatgaggggcgactaggcgcgaggacgagcaaaagcaagtggatgacagcatgaacggccctgcggggctggccggacggctgcaagaacatgctgagcccaaagatcaggcaggccaggagggcccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccagggatttatttctctacaagggacacaggtgactgaacttcctcctggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccgctgggcggaggtactgcccgtagatcgcatgcccaccctctagaacccttgcctccagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttg

SEQ ID NO: 1351 - DNA, 2764 bp, Homo sapiens
  ENST00000460425
agaggcgccgagcagccgggagctccgtcctgcctgaggatgcggggcccaggctgcatccccccggccctgctcgcctgctcatcacacggaggccggggacagggtcacggccagggagcctgcggggctaaaggagcgggccgggagctcaagagctgccgccgggcggcgaggaaggagccccaggcaggccccgggcggccgaggcaggggaggagacggctggccctggttccaggtgagcagccccgcccgctctgctggaggccccgcttaccaccggcgggagatgcgggtgcaagccctggggcgcacgtggccaggccactgccacgcccgagggacgggttttcgtcgccacctcggccctggtgaaccctgtgactggagtgcctcccaatcccaccgtgatgcccacctcggggcgctgccaggtgccaggctaatgcgtgtgatccacagtgtgctgagaagtgctgactgtcattgtgaatgtccgtggtggggtgacgcccgggcagggtgcactggcctggttccagaagacctggcctctccagctcccacggcgcgcccgtttgctgcgtggcccatgctgctggcggctgctcctggctgagtcattccaagacgagcgtccagtccgcgctctctgccgcccttcccagcgctgcccggcaggccccgggaactgtgcccagctgtgcccgcttagctggtgtatgacctgcctttgaacttgctgcaaagaaagatgtggatctcctgttactggaaaacaggaattagcttgtctgcttgaggatgtggttggttctttataaaaaggatacagaagaaatttgcacagactgccagcttcattatgctgccgacagcttccagcaaaaggaggacgtttgcagccagatatttcacccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccagggatttatttctctacaagggacacaggtgactgaacttcctcctggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccgctgggcggagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggacc

SEQ ID NO: 1352 - DNA, 496 bp, Homo sapiens
  ENST00000515523
aatgcagcaacggggagccaggggcatgctggggaagagcattccagcagagacatggacacgtgcgaaggccccgaggtagggacgagctttgggaacacgaggcatgtcaggaaggccggggccccgagggagtgaagaccaggcgagtgggagggcctgagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggta

SEQ ID NO: 1353 - DNA, 690 bp, Homo sapiens
  ENST00000471013
gccccgccctggtccagtgattgatcagcagtgattactgaggctttaatggtccgcttggatgggaattaattctgggatggataaataatgcatcgaggtttatgtagtccaaggcgagccgtccgtccggagccaggagaggtagccgagggagcctgacgggtgacgccagcggccacggggccccgaacgagcaggacatgaggggcgactaggcgcgaggacgagcaaaagcaagtggatgacagcatgaacggccctgcggggctggccggacggctgcaagaacatgctgagcccaaagatcaggcaggccaggagggggatttatttctctacaagggacacaggtgactgaacttcctcctggccccgaggacccagggaagcacctctttgagatcagcccagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttt

SEQ ID NO: 1354 - DNA, 467 bp, Homo sapiens
  ENST00000489984
cgcgccgccgcgataggcgcgccatgggcctgatgccggccgcgcgggcctactccgggatgcagcgcttgcccgcggccgccttgccgcttgcccgcttgttgcgcgcccgccgccccagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcac

SEQ ID NO: 1355 - DNA, 733 bp, Homo sapiens
  ENST00000493012
agcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccagggatttatttctctacaagggacacaggtgactgaacttcctcctggccccgaggacccagggaagcacctctttgagatcagcccagagcaaaaactggagttcaataaggacaggcccaacttgtcactaactcaccttacagtgcctggcgcaaagtaggccctcaagagattgctcgtgaacatatacaccatggaatactatgcagccataaaaaaggataagttcatgtcctttgtagggacatggatgaagctggaaaccatcattctcagcaaactatcacaaggacaaaaaaaccaaacactgcatgttctcactcataggtgggaattgaacaaagagaacacttggacacaggaaggggaacatcacacactggggcctgtcatggggtggggggttgggggagggatagcattaggagatatacctaatgtaaatgaagagttaatgggtgcagcacaccaacatgacacatgtatacatacgtaacaaacctgcatgttgtgcacatgtaccctagaacttaaagtataataaaaaaagaaaaaaaa

SEQ ID NO: 1356 - DNA, 912 bp, Homo sapiens
  ENST00000491108
agccaggagaggtagccgagggagcctgacgggtgacgccagcggccacggggccccgaacgagcaggacatgaggggcgactaggcgcgaggacgagcaaaagcaagtggatgacagcatgaacggccctgcggggctggccggacggctgcaagaacatgctgagcccaaagatcaggcaggccaggagggcccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccaggaagcatgatgctgacctctgctcagcttctggagatgcctcaggaaacttagaatcatggcggaaggcaaagagggagcagtcatgtcacatggccagagcaggagcaaaagagagagcagggaggtgccacacacacttttaaaccaccagatttcgtgagaattcactctattttgaggacagcaccaagaagatggtgctaaccactcaagagaaaccgcccccatgatccaaataccttccgccaggccccacctccaacactggggattacaattaaacatgagatttggatggagacacagagccaaaccatatcacgctccttccctgagtccttgacctggagtagatgcctgggttgtctccatttctcaaatgaggaaactgaaggactgacatcaggccaagactaacaggtactcactctcagatagcgcctgaaagctgacacaagttcagtgagactgctaggacaaccccctgccgtgccattaatgtctgcccacaaaaacc

SEQ ID NO: 1357 - DNA, 432 bp, Homo sapiens
  ENST00000511570
agaggagcatcatgaagaactggcagcagcgctggtttgtgctgcgtggggatcagcttttctactacaaggacaaagatgagatcaagccccaggagaataagtgagggaagctcagcaataaggagccatagaagattgatttaaagtttgatgtgattgagtaaaagcttgagactggtggggagaaagtcaagatggatgggaaagcacatgcacttctaggagtggaacattaatattggacagtcggaaaccagaaatctttaagaaagaggaaacctcaggggaagaaagagaggccatcctatcccataacttgaaagtcacaggaatatttcagcctgcagggaatcttcatttcccaccccattgtttaccaaacttgcacgtcaaaaacaaaaacaaaaaataaaatgttgctttcatgaa

SEQ ID NO: 1358 - DNA, 520 bp, Homo sapiens
  ENST00000464445
atacagaagaaatttgcacagactgccagcttcattatgctgccgacagcttccagcaaaaggaggacgtttgcagccagatatttcacccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccaggtgagaagtgcatgtccggtgtgccgtgggcatcgtggcagggctccacaagagggaagaccatgcccaggagaagggaggaaggcacagagccactgactccatcacagtgatgttttgccaggatttccaaagtaattttcattcttatcccccatgttcctggtatcacagcctgttttactggaacatgtccacaacttctgcaatgaaaatgtttccttaaaatgtt

SEQ ID NO: 1359 - DNA, 471 bp, Homo sapiens
  ENST00000633445
ttgcgcttggcggtcgccgggtgcagctgcccggacagggcgcatggaggggccgcctccccctgcgccccccggggccggcgcggcgaggacggcatagcagggcccagcatggagcagctgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagct

SEQ ID NO: 1360 - DNA, 5964 bp, Homo sapiens
  ENST00000622683
ccgcccctcccgggtccctgccggcgcccccagccgtgccccggccgcagagccgccgctgccacccgatgaatggagtcgccttctgcctggtcgggatcccgccccgcccggagccccggcccccacagctgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccacccccgatctgctacccccgcaagacctacgcccctcctgcccgggcctccaccagggccactatggtgcctgagcccacctcagcactgcccagtgacccccggagtcctgctgcctggagtgacccggggctccgtgtgccacctgctgcccgtgcccacctggacaactcttccttggggatgagccagccccgccccagccctggtgccttcccccacctctcctcggagccccggacgccccgtgccttcccagagcctggcagccgggtgccccccagcagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccaggagggctggcaccgagctcgctcagatgactacttgagccgggccacccgttctgccgaggcactggggccaggggcactggtgtcaccccgctttgagcggtgtggctgggcttcccagcgttcgtctgcccgcacccccgcctgcccaactcgggacctgccagggccccaggccccacccccgtctggcctgcagggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcgcgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggctactccaccctgtccaccatggaccgcagcgtgtgctcgggcgctagcggtcggcgggcaggggcgggggatgaggcggacgacgagcgtagcgagctgagccacgtggagacggacactgagggcgcggcgggcgcggggcctggggggcgcctgacacgccggccgtccttcagctcgcaccacctcatgccctgcgacactctggcgcgccgccgcctggcccggggccgcccagacggcgagggcgcgggccggggcggtccccgcgccccggagccgcccggctcggcgtcgtccagcagccaggagtcgctgcggcccccggcggcggcgctggcctcccggccctcgcgcatggaggcgctgcgtctaaggctccgcggcacggcggacgacatgctcgccgtgcgcctgcggcggccgctgtcgcccgagacccggcggcgccggagcagctggcgccgccacaccgtggtggtgcagagcccgctgactgacctcaacttcaacgagtggaaggagctgggcggagggggccccccggagcctgcgggcgcgcgggcgcacagtgacaacaaggactccggactcagcagcctggagtccaccaaggcgcgggccccgtcgtccgctgcctcgcagccgcccgcgcccggggacacggggtccctgcagagccagcccccgcgccgctcggccgcctcccgcctgcatcagtgtctgtgatccccacctcccgcgccgctcgggcgccacccctccctagagcccctttggaaccaggaggcttcaccagcctgcacctcctcttctgtggcccctgggtgcatggtgtgggtggagggcgcagcaggcagtgtctctagttggtgtgctggaactggcagggcagaggagaaggctggggccggactaattgaatggaagggggttccagaggtgatgagcagaagaggagggggcgtgggctgctggggtctgtgtccctgcacacatgcgcccgataggtccttctgagcctttctgtggctgcacttggggacccttgtggaccatggggtgtggctagggaacccctaagtttcagactaaaggaaagatcctgggtgatgctggctttttgcttctttcttctgccctcccacctcagcttgtaagcggggatgtgtgtatgtctggggagaggaggtgtagggtgcgtatgtccatggggggaggggcttgtgtgtgcagtcattgtcccaaggtgtttccagtagcgacttctgtccccctatccccaccctggtccccactttgcgcccccgggctccctgcctttggtgcacacaggatcctgcccgccccccttgccagagccagagaagggggttggggccattccaaggaggcaggactgaaaccctcaccagggttactccccaacatccttttgcctgagtcaccctctaagcgctttaaccacgggcagctgcctgttccccagacagtttttggtggggggggtccagggtcccccttgctggtacctccctcacccctctttttgtttttccatctgtgcctgttccttccacagcccaggcacacagaagcccaccttcttccccttaggaggagggatagtcaacacccctgctgtctctctgtcactcacacactgatttatggggtctgagctgggctgttcctgcaggatggacaggacccagcgccctcttctccccacaggctgtaaatagacttccaatcaccaggccagcccccacacaccctcactcattccagggaagcccaggtaggtggtgaacccgctgccacgtctatcagtcctcttgttttatgcaaagatttactgtaaagtagatttctttccctccctcccccattcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggcatga

SEQ ID NO: 1361 - DNA, 3663 bp, Homo sapiens
  ENST00000620417
atgaatggagtcgccttctgcctggtcgggatcccgccccgcccggagccccggcccccacagctgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccacccccgatctgctacccccgcaagacctacgcccctcctgcccgggcctccaccagggccactatggtgcctgagcccacctcagcactgcccagtgacccccggagtcctgctgcctggagtgacccggggctccgtgtgccacctgctgcccgtgcccacctggacaactcttccttggggatgagccagccccgccccagccctggtgccttcccccacctctcctcggagccccggacgccccgtgccttcccagagcctggcagccgggtgccccccagcagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccaggagggctggcaccgagctcgctcagatgactacttgagccgggccacccgttctgccgaggcactggggccaggggcactggtgtcaccccgctttgagcggtgtggctgggcttcccagcgttcgtctgcccgcacccccgcctgcccaactcgggacctgccagggccccaggccccacccccgtctggcctgcagggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcgcgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagcggacctgttggagatttaaaggattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgc

SEQ ID NO: 1362 - DNA, 546 bp, Homo sapiens
  ENST00000616767
gccttcagccgggaggcgcaggaggcgcggagccaatccagccgtcctgccgccgtccgcgcgggccgtccgtcccttcggggcccccgggccccgggcccgcggctccggggggcgggcggggacccccggggcccgccggccgcccggggggtcgaggacgccgtctgccgggcgcctagcagcggccccgggcccccgcgcggcgcgcgcgtctccggaagcccggcctggggcgtactggggccggggcagtggccgggcccgggagcccccgccggccgcggagctggtgggcagcgccgtgtggcgcgtggagcgcgcgggggccgggggctggcgctgggagcgcgccgtcggcgtggactgcagcgccccggaaccgcgctgcctctggctgccctgcctcagccacagcgaccgccgcgcgcccgggccgcgccgggccaggctgccactgggcccaagagatgggtgctctcctaggcgccccttcccctggcaggggccgaggacgctgctgctgtacaaaagtccccaggacgg

SEQ ID NO: 1363 - DNA, 969 bp, Homo sapiens
  ENST00000618942
gaaggatgcgtgtgtgccggtctgctgtgcatgtgtgtatctgcatgtctgtgatgcatgcgcatgcgtctgtatgtgcattgtgtgtgcaggactttgattctgtgcaactctgtgcatatctatgtgtctacaaaagtgtgcacatgtgtactcatttgtgtgtgtgtatctgtgtgtctgcatatttgcacatgcttgtctgtatgtttgtggtatgttccgtctacatgagtgtatgtggctggggctgtgtctgcataagtatgtgtctatctgggagtgcatatatgtgtgcatgtgtgtgtgtgagattgtgcatgagctaagacaacgacaggcacttcctgggcaggaaggctgtatccagggtcctgcacatagtaggtgctcagtgaacatttgctgaactcagctgaactgaactgaatgaacttgcttcactgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccacccccgatctgctacccccgcaagacctacgccc

SEQ ID NO: 1364 - DNA, 769 bp, Homo sapiens
  ENST00000619156
tccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccag

SEQ ID NO: 1365 - DNA, 488 bp, Homo sapiens
  ENST00000616909
cgaccttcagcgatatcaggagagaaggctggttgtattataagcagattctcaccaagaaggggaaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcatt

SEQ ID NO: 1366 - DNA, 438 bp, Homo sapiens
  ENST00000620325
cgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatggtgcccttctcttctgacctgctgaaccttggtgtccatgtcctggagacgggggcagggaccccttttctgggatcagcatgcagctcagatggtattgcctcccaaatgaacacagctgggctaccccaggtcaggtgcacacccgagtgtagctgtgacaaatacaacgacttcatcgaggccaaccgcattgaggacgc

SEQ ID NO: 1367 - DNA, 407 bp, Homo sapiens
  ENST00000620329
atccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagc

SEQ ID NO: 1368 - DNA, 405 bp, Homo sapiens
  ENST00000617798
ctatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcacgtaagcccctgttccggggggcgcccggcagcccctggggcccaggccatgttcctctgagcccctcgctcttgctccgcctggcggagtgtgccccaggaagggctcggcagctttagagcatgctgctagggtggtatatactcctccaaagccatgggctgcatttcaaggcaaggcaggaatggatcctggaatccctgctgccctgg

SEQ ID NO: 1369 - DNA, 659 bp, Homo sapiens
  ENST00000614693
gttcttcagtgacgaagaggacaagggagagagaacccctgtgggcgacaaggagcctcaggcagtgcccaacattgagtacctcctgcccaacattggcaggacagtgccccctggcgacccggggtcagattctaccacctgtagttcagccaagtccaaggtacgtatgaaggcaattctgaaggcttgatccctgtacaaggcagcccactttggtttttgttcaagggaattgagggaatggcagttggaccatggggaaagttgatggtccctgggagggaaggcaggaggtaccgagtgcccaaggtaagctgagaaattgcttaccttggcagtgtttggtgaggcatctgctgtagtagaaggacctggcctgggagttatgtggctaggaggcaatgtcactcagtagttagaagcacagactctgcagtcagacagtcctgggtttgagttctggctccaccatttagtagtttgggacattgggcaagttacttaaccactttctgatccttagcttcctcatctataaaatgggaatatcagtaaatctgtggggtgctataataaataaaacagatatcctttaaggtctttggagagcctaaagcaagcagaaggaaataaagagaggagcagaaatccatgaa

SEQ ID NO: 1370 - DNA, 471 bp, Homo sapiens
  ENST00000618325
atcggtaaatgaggggccagtggctggcagcctgatgtcacttcctgcctctagaggaagtggcagttaacatcattttctcctccatccctctcccatagatggacatcagatgtccatcatactcctagggcctggggagatctcatgtttcagaattccctggtttctgaagcctttgaggagagggaattgtgtgcataagactcagctttcttttttcctgatgcaactttcatttttttttctgtctttcaccaacagattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccgg

SEQ ID NO: 1371 - DNA, 5964 bp, Homo sapiens
  ENST00000610551
ccgcccctcccgggtccctgccggcgcccccagccgtgccccggccgcagagccgccgctgccacccgatgaatggagtcgccttctgcctggtcgggatcccgccccgcccggagccccggcccccacagctgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccaccgccgatctgctacccccgcaagacctacgcccctcctgcccgggcctccaccagggccactatggtgcctgagcccacctcagcactgcccagtgacccccggagtcctgctgcctggagtgacccggggctccgtgtgccacctgctgcccgtgcccacctggacaactcttccttggggatgagccagccccgccccagccctggtgccttcccccacctctcctcggagccccggacgccccgtgccttcccagagcctggcagccgggtgccccccagcagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccaggagggctggcaccgagctcgctcagatgactacttgagccgggccacccgttctgccgaggcactggggccaggggcactggtgtcaccccgctttgagcggtgtggctgggcttcccagcgttcgtctgcccgcacccccgcctgcccaactcgggacctgccagggccccaggccccacccccgtctggcctgcagggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcacgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggctactccaccctgtccaccatggaccgcagcgtgtgctcgggcgctagcggtcggcgggcaggggcgggggatgaggcggacgacgagcgtagcgagctgagccacgtggagacggacactgagggcgcggcgggcgcggggcctggggggcgcctgacacgccggccgtccttcagctcgcaccacctcatgccctgcgacactctggcgcgccgccgcctggcccggggccgcccagacggcgagggcgcgggccggggcggtccccgcgccccggagccgcccggctcggcgtcgtccagcagccaggagtcgctgcggcccccggcggcggcgctggcctcccggccctcgcgcatggaggcgctgcgtctaaggctccgcggcacggcggacgacatgctcgccgtgcgcctgcggcggccgctgtcgcccgagacccggcggcgccggagcagctggcgccgccacaccgtggtggtgcagagcccgctgactgacctcaacttcaacgagtggaaggagctgggcggagggggccccccggagcctgcgggcgcgcgggcgcacagtgacaacaaggactccggactcagcagcctggagtccaccaaggcgcgggccccgtcgtccgctgcctcgcagccgcccgcgcccggggacacggggtccctgcagagccagcccccgcgccgctcggccgcctcccgcctgcatcagtgtctgtgatccccacctcccgcgccgctcgggcgccacccctccctagagcccctttggaaccaggaggcttcaccagcctgcacctcctcttctgtggcccctgggtgcatggtgtgggtggagggcgcagcaggcagtgtctctagttggtgtgctggaactggcagggcagaggagaaggctggggccggactaattgaatggaagggggttccagaggtgatgagcagaagaggagggggcgtgggctgctggggtctgtgtccctgcacacatgcgcccgataggtccttctgagcctttctgtggctgcacttggggacccttgtggaccatggggtgtggctagggaacccctaagtttcagactaaaggaaagatcctgggtgatgctggctttttgcttctttcttctgccctcccacctcagcttgtaagcggggatgtgtgtatgtctggggagaggaggtgtagggtgcgtatgtccatggggggaggggcttgtgtgtgcagtcattgtcccaaggtgtttccagtagcgacttctgtccccctatccccaccctggtccccactttgcgcccccgggctccctgcctttggtgcacacaggatcctgcccgccccccttgccagagccagagaagggggttggggccattccaaggaggcaggactgaaaccctcaccagggttactccccaacatccttttgcctgagtcaccctctaagcgctttaaccacgggcagctgcctgttccccagacagtttttggtggggggggtccagggtcccccttgctggtacctccctcacccctctttttgtttttccatctgtgcctgttccttccacagcccaggcacacagaagcccaccttcttccccttaggaggagggatagtcaacacccctgctgtctctctgtcactcacacactgatttatggggtctgagctgggctgttcctgcaggatggacaggacccagcgccctcttctccccacaggctgtaaatagacttccaatcaccaggccagcccccacacaccctcactcattccagggaagcccaggtaggtggtgaacccgctgccacgtctatcagtcctcttgttttatgcaaagatttactgtaaagtagatttctttccctccctcccccattcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggcatga

SEQ ID NO: 1372 - DNA, 3663 bp, Homo sapiens
  ENST00000631799
atgaatggagtcgccttctgcctggtcgggatcccgccccgcccggagccccggcccccacagctgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccaccgccgatctgctacccccgcaagacctacgcccctcctgcccgggcctccaccagggccactatggtgcctgagcccacctcagcactgcccagtgacccccggagtcctgctgcctggagtgacccggggctccgtgtgccacctgctgcccgtgcccacctggacaactcttccttggggatgagccagccccgccccagccctggtgccttcccccacctctcctcggagccccggacgccccgtgccttcccagagcctggcagccgggtgccccccagcagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccaggagggctggcaccgagctcgctcagatgactacttgagccgggccacccgttctgccgaggcactggggccaggggcactggtgtcaccccgctttgagcggtgtggctgggcttcccagcgttcgtctgcccgcacccccgcctgcccaactcgggacctgccagggccccaggccccacccccgtctggcctgcagggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcacgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagcggacctgttggagatttaaaggattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgc

SEQ ID NO: 1373 - DNA, 546 bp, Homo sapiens; identical to SEQ ID NO: 1362
  ENST00000633736

SEQ ID NO: 1374 - DNA, 969 bp, Homo sapiens
  ENST00000632947
gaaggatgcgtgtgtgccggtctgctgtgcatgtgtgtatctgcatgtctgtgatgcatgcgcatgcgtctgtatgtgcattgtgtgtgcaggactttgattctgtgcaactctgtgcatatctatgtgtctacaaaagtgtgcacatgtgtactcatttgtgtgtgtgtatctgtgtgtctgcatatttgcacatgcttgtctgtatgtttgtggtatgttccgtctacatgagtgtatgtggctggggctgtgtctgcataagtatgtgtctatctgggagtgcatatatgtgtgcatgtgtgtgtgtgagattgtgcatgagctaagacaacgacaggcacttcctgggcaggaaggctgtatccagggtcctgcacatagtaggtgctcagtgaacatttgctgaactcagctgaactgaactgaatgaacttgcttcactgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccaccgccgatctgctacccccgcaagacctacgccc

SEQ ID NO: 1375 - DNA, 769 bp, Homo sapiens; identical to SEQ ID NO: 1364
  ENST00000633443

SEQ ID NO: 1376 - DNA, 488 bp, Homo sapiens; identical to SEQ ID NO: 1365
  ENST00000633302

SEQ ID NO: 1377 - DNA, 438 bp, Homo sapiens; identical to SEQ ID NO: 1366
  ENST00000632895

SEQ ID NO: 1378 - DNA, 407 bp, Homo sapiens; identical to SEQ ID NO: 1367
  ENST00000631490

SEQ ID NO: 1379 - DNA, 405 bp, Homo sapiens; identical to SEQ ID NO: 1368
  ENST00000633368

SEQ ID NO: 1380 - DNA, 659 bp, Homo sapiens; identical to SEQ ID NO: 1369
  ENST00000634129

SEQ ID NO: 1381 - DNA, 471 bp, Homo sapiens; identical to SEQ ID NO: 1370
  ENST00000633715

SEQ ID NO: 1382 - DNA, 4661 bp, Homo sapiens
  ENST00000395184
ttgtactgtatatttacacattcacacacaatcaccctttctaacttctgggactctttgcgcaactgctaggatttctcaagtgcatgtggcaacacagcccagctccgggtggaaaccagcagggctctggaggggctcggagaccaggggagctgtcaaggctgcggcggggaccagagaggagcctggcgggggtggctgggtggctgggggaatccccccaacttcccatcgcaggcgcagctctctcggccgcctatttcctccgaaacccgcgctgcggagcagcccagtgcatagagttcaacacttccccttgttgtggaaagtaaaggagcctcactaccacctttttttctttgcgttttcttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaatactttgtggctgtgctgtttgtgccaatagactttgtcatgaccaaaaagagaaatgtaaatagttttataaaatacagtcgaatcaccaggaacctttgagctgcttttaaaattcttcccctggcaccactcagttttgcttttgcgaggcgatttgacataggaactttgagactccatgagaaagtccctttctgaggcccactgtctaccttgccagatcctcagtgcgtatcgccaatgcaggatgctccttagaaaagaaaaaatggtaaagaatggcatttaacgattcaggctttgaattactctgtccctctggaccgaatctctttaactgctggatagttttagaggaattctcctgctacttaggtactgggaaacaatgcttgctaaaccatgcccacgtgagcacctgtctcccactcaaacctctcccatctcccaacaactgcactttagaataccagcagtgaaatggtattactgtttccctctgagtgaaactgctagagtatatgtcacgtagtgacatttttttctcactcaggctattgccatctgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacatacttgagtttatggggtttgtgttgtttgaaggttcaatgcttgcatgtgtttatttattttcaagagggaaagtggtctgtactgctttcatccttgccactgtcttgcttttattttttactctcccactgagcaagcgtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactcccataga

SEQ ID NO: 1383 - DNA, 1273 bp, Homo sapiens
  ENST00000503995
gggctctggaggggctcggagaccaggggagctgtcaaggctgcggcggggaccagagaggagcctggcgggggtggctgggtggctgggggaatccccccaacttcccatcgcaggcgcagctctctcggccgcctatttcctccgaaacccgcgctgcggagcagcccagtgcatagagttcaacacttccccttgttgtggaaagtaaaggagcctcactaccacctttttttctttgcgttttcttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcagtaagttgatgcatttatttccaaataagcttttgtttggaatttttttctgtgttcttagtcttaaatctgtaaatttccattgccctatcccggtgttactctccactatcctttgaattgacctcacacacactgagactttccgtatacagctcaagcaccatttccgatcccctctctgatcaaaaaaaaagaa

SEQ ID NO: 1384 - DNA, 857 bp, Homo sapiens
  ENST00000506421
aagtaaaggagcctcactaccacctttttttctttgcgttttcttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccagaggtctacttttccattcagtctgctagctgcaaggaggtttcatcttttggtgaagaagttctcaagtaatatagacggatattttcaatactgttttagagagagccatgtcttcaagaccaggaagtaacagataaaacctcttctccaacattgctattctaaatcatctgtttcacatgcagtgcgtatgacataatggcttttgatgaacaaagcctaagaagtttaagactgtgtaatatggaatatgaaggttgtcctttcaaacaaatttataggaaattcaagcttgcttctgtaattatggacttaaatatagtatgtgagtagatcatttgaaaagatgcttcctgaattattaatacagtatgtaatagctgctaaattaggttttataattctaaatcatcttacggagtgtgaagagaagtgttccaaatgtatctt

SEQ ID NO: 1385 - DNA, 485 bp, Homo sapiens
  ENST00000505856
ttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttggtgagtaggagaaaatgtaaagcattaagggcctaagaaagccaagaaatagagggatttgctagaaaccgattgggactgagaccacccaaagctccctggtctccttcagttcattgtcatctttcacccttttacccattgcttgctttgagttggagataataaaatcgctaattgaggccaagaggcaaattatacttgtctaata

SEQ ID NO: 1386 - DNA, 631 bp, Homo sapiens
  ENST00000509709
cagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccaggtaagatattttcctagtctgattaaattattgtcatcctgtgttggtaaaggtgaagatgggtcagacaggtttcattcttttttgaatcatgactgagaaccttaatttgaggcttggttagtgttgacgcagataatgactgcaggtttatatactagtacaaatgaatgcactcacacacacatactctgaccacataactactggattttcatttgtccatgagactccatagttgaccacaagtcatgatacagtatttgttcaggactattggagatgaatttgattttacagcgctcttgtgatgtgaaatttgacaaggggttataggttgaatgctttgcccagtggaatcactgacatatttcctcacaaaattgtatcttcaaggaggttttgcaaaaaaca

SEQ ID NO: 1387 - DNA, 567 bp, Homo sapiens
  ENST00000512201
ataactcattaggcttgaatgagatgctttgaactgtggtgactacagtaatgttcccctctgcatgttgaagtgacaagtgcctccttggcctattgctgatcctgcctgctgtagaaatctccagctgtccaatatttggaagaaaactggctgtgcgtgtagtagagatgctctctctttgtgaagaaggccctgcatacattaaacaagtccggtactatttttctgcctggaaataaagtttctgagcatccctgcaatgaagagaacccagggaagttcctttttgaagtagttccaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgcca

SEQ ID NO: 1388 - DNA, 2740 bp, Homo sapiens
  ENST00000395183
ggatgggaggatactgactaagtctgagaaggaggagaaagaaaattagctacaggaagagtttatatccccttctacaagaaaacttaaatatagctaccaccgctttgaaaggaatggtttgtgtccaaacagcattttccagacaagctctgtacttttttgccaaaagaattaactttaaactgaaggcagtggacagttaaacaagagtcggcactgggaacagctgtgcgtagaccagaccagtgacttataaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaata

SEQ ID NO: 1389 - DNA, 572 bp, Homo sapiens
  ENST00000509300
tttttacctgagctcagtagctggggagcccactagtgctggggagcgagccgtggtttccattcctgggtgatggagtcatgggagaaactgcagtgagcaaacacagtaggacctgagttgggctcgaatgtgctttaagcgactcaggacagagcagctgctctgtctcccagcttgcaagtgcagcctgcatttgtcactgaccactgaagtgtatgtttgtgcaaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagca

SEQ ID NO: 1390 - DNA, 1936 bp, Homo sapiens
  ENST00000514229
aggacagagcagctgctctgtctcccagcttgcaagtgcagcctgcatttgtcactgaccactgaagtgtatgtttgtgcaaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagca

SEQ ID NO: 1391 - DNA, 725 bp, Homo sapiens
  ENST00000502537
tcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcaggtttcatcaaagacatttgtaactgaattctgttagaaaaataattgtgccagaaaaataattgtgcctggaaaatatacctctcaatgtataactcaagacctgggatgggatatgccatatatgtgctcctgtttaagaaaccaaatatgcaaaattgaaacagaataaatttaaatagagagtgatgattggcactacaagtcactgcagggtgtcttacatgatagcttcccagtccattttaaaataaaattcaaagttttaattgag

SEQ ID NO: 1392 - DNA, 429 bp, Homo sapiens
  ENST00000503917
ttttatattttagaataacttcaaaagcttagttttaaaagttggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacaggtagatgtcacaattttactagccatcttcactgagaaattcagactcaactgacaggatgcagtgagctgaggaggcataaccttgattgatgtggtaacagtttacaacatagattatttggccacaggagtttgcattgtttctattaagttacaaagtcaaaaattgggcacc

SEQ ID NO: 1393 - DNA, 4572 bp, Homo sapiens
  ENST00000264343
gggagtttgaagacagaaaggaaaggggagaaacctgcagagagcatcaaaggatggggggtgctataaaagaagcaggggggtcctttgaaagaaatctatcatgcactgaaatgctttctggagaaggtgccattattttcctcccctcttgctcagatgaaaggagccagcaaggacagtcctgaaatattcctcaggggactttttgtcattgttcctctttcctcttgcacagagctatttgctgacctttccagaggaatctcagtccagctgagaagacagttcttaataaaaacaaaaaaatgcaaaaaccaattcctgctgtttgaatgggaatggtagcttgcttgctgcagttcttttcctgtgacattttggaatgtctgcagaaacttaaaaaaaagaaaaaaaaaaccttaaaaactccctggattaggcaagagaaaaggaagtttttttttgctaaacaggagtaaatgagaggtggtaacttatccctaagccaggacctggatgatcaaaaccttcaaattctagggatcagcacttcaaaaataacaagtaaacaagcatgaggagtggctgttgggtttcgctcagaggcaggttttaaaggaagccaaaaccgggttcagaacttcaggcctgtacgatgcctgaagaccggaattctggggggtgcccggctggtgccttagcctcaactcctttcatccctaaaactacatacagaagaatcaaacggtgttttagttttcggaaaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaatactttgtggctgtgctgtttgtgccaatagactttgtcatgaccaaaaagagaaatgtaaatagttttataaaatacagtcgaatcaccaggaacctttgagctgcttttaaaattcttcccctggcaccactcagttttgcttttgcgaggcgatttgacataggaactttgagactccatgagaaagtccctttctgaggcccactgtctaccttgccagatcctcagtgcgtatcgccaatgcaggatgctccttagaaaagaaaaaatggtaaagaatggcatttaacgattcaggctttgaattactctgtccctctggaccgaatctctttaactgctggatagttttagaggaattctcctgctacttaggtactgggaaacaatgcttgctaaaccatgcccacgtgagcacctgtctcccactcaaacctctcccatctcccaacaactgcactttagaataccagcagtgaaatggtattactgtttccctctgagtgaaactgctagagtatatgtcacgtagtgacatttttttctcactcaggctattgccatctgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacatacttgagtttatggggtttgtgttgtttgaaggttcaatgcttgcatgtgtttatttattttcaagagggaaagtggtctgtactgctttcatccttgccactgtcttgcttttattttttactctcccactgagcaagcgtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactcccata

SEQ ID NO: 1394 - DNA, 1227 bp, Homo sapiens
  ENST00000463483
gtttacctaagctagcctgggcaatggcgggcgcccctcccccagcttctctgcggccttgcagtttgatctcagactgctgtgctagcaatcagcgagactccgcgggcgtaggaccctccgagccagagtctcctgcaatgattcagacttggctttactggcttcttccatagataagcaccagcctaggagctctcaaagttgttccagctaaaggacacactcagcttttggtctacagtgacttccagcctaagtggctctggacactgctggaaccccccgctccatctccctccataaatatgtctctgcagcagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaagaactacaggaacaggaatgactgccaaagtgttgtttctgcacagatacaccaattctgtcccagggtctccttgctggcacatgggcaggctcatttactggtaaatgatttacttgtgtaaatctcttcccaggctcagcaggagttgatgaagca

SEQ ID NO: 1395 - DNA, 908 bp, Homo sapiens
  ENST00000481684
aaagggaactccctgaccccttgcgcttcccaagtgaggcaatgcctcgccctgctttggctcgcgcacagtgcgcgcacccactgacctgcgcccactgtctggcactccctagtgagatgaacccggtacctcagatggaaatgcagaaatcacccatcttctgcgtcgctcacgctggtagctgtagaccggagctgttcctattcggccatcttggctcctcctcaatttttgtatatagtgaaagagtctcctgcaatgattcagacttggctttactggcttcttccatagataagcaccagcctaggagctctcaaagttgttccagctaaaggacacactcagcttttggtctacagtgacttccagcctaagtggctctggacactgctggaaccccccgctccatctccctccataaatatgtctctgcagcagtaaatgctaaagggagtccttcctgcaggttgatataaaaggacactaaacaataacttgatgccatatgaagaaaaaaagatctcagcaaagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaa

SEQ ID NO: 1396 - DNA, 582 bp, Homo sapiens
  ENST00000491237
gagatgaacccggtacctcagatggaaatgcagaaatcacccatcttctgcgtcgctcacgctggtagctgtagaccggagctgttcctattcggccatcttggctcctcctcaatttttgtatatagtgaaagagtctcctgcaatgattcagacttggctttactggcttcttccatagataagcaccagcctaggagctctcaaagttgttccagctaaaggacacactcagcttttggtctacagtgacttccagcctaagtggctctggacactgctggaaccccccgctccatctccctccataaatatgtctctgcagcagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaa

SEQ ID NO: 1397 - DNA, 2945 bp, Homo sapiens
  ENST00000409202
agtaaggcctgagattctttcgaaaaggagctttgcttcccatgacgcagagggaagtgtcaactgggatatttctggtaaaactgaaagcaagaaaagcagggtgctagcccctgtgggactgagggtggaggctgggggagtttgggtgccatcctccagtgacagatggatggacctttcatctaagagaaaggaggagacacgttggcaaatcagcctcaagcctaagattgcttgtgaagcaatcataaggaggaacaaaaacagacacaaaaacagagggaaagagtgaaaagacaagaagggcgcaaactgtgacagactcaccgcttcactaactactcacttaaactggaagcaaaatgtccctaaaattgccaaggaactgggatttcaacctgaaagtggaggctgcgaaaatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 1398 - DNA, 1000 bp, Homo sapiens
  ENST00000456116
ctttgcttcccatgacgcagagggaagtgtcaactgggatatttctggtaaaactgaaagcaagaaaagcagggtgctagcccctgtgggactgagggtggaggctgggggagtttgggtgccatcctccagtgacagatggatggacctttcatctaagagaaaggaggagacacgttggcaaatcagcctcaagcctaagattgcttgtgaagcaatcataaggaggaacaaaaacagacacaaaaacagagggaaagagtgaaaagacaagaagggcgcaaactgtgacagactcaccgcttcactaactactcacttaaactggaagcaaaatgtccctaaaattgccaaggaactgggatttcaacctgaaagtggaggctgcgaaaatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggca

SEQ ID NO: 1399 - DNA, 2247 bp, Homo sapiens
  ENST00000467265
cagagggaagtgtcaactgggatatttctggtaaaactgaaagcaagaaaagcagggtgctagcccctgtgggactgagggtggaggctgggggagtttgggtgccatcctccagtgacagatggatggacctttcatctaagagaaaggaggagacacgttggcaaatcagcctcaagcctaagattgcttgtgaagcaatcataaggaggaacaaaaacagacacaaaaacagagggaaagagtgaaaagacaagaagggcgcaaactgtgacagactcaccgcttcactaactactcacttaaactggaagcaaaatgtccctaaaattgccaaggaactgggatttcaacctgaaagtggaggctgcgaaaatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaagga

SEQ ID NO: 1400 - DNA, 599 bp, Homo sapiens
  ENST00000485573
gggactgagggtggaggctgggggagtttgggtgccatcctccagtgacagatggatggacctttcatctaagagaaaggaggagacacgttggcaaatcagcctcaagcctaagattgcttgtgaagcaatcataaggaggaacaaaaacagacacaaaaacagagggaaagagtgaaaagacaagaagggcgcaaactgtgacagactcaccgcttcactaactactcacttaaactggaagcaaaatgtccctaaaattgccaaggaactgggatttcaacctgaaagtggaggctgcgaaaatagtaaatgctaaagggagtccttcctgcaggttgatataaaaggacactaaacaataacttgatgccatatgaagaaaaaaagatctcagcaaagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccc

SEQ ID NO: 1401 - DNA, 990 bp, Homo sapiens
  ENST00000488795
gaagcaatcataaggaggaacaaaaacagacacaaaaacagagggaaagagtgaaaagacaagaagggcgcaaactgtgacagactcaccgcttcactaactactcacttaaactggaagcaaaatgtccctaaaattgccaaggaactgggatttcaacctgaaagtggaggctgcgaaaatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggtgagaggcccctggtatcaactctgcagttttcaaccccatcagaaagaagctcctagttagaagaggagggaccacgtctgtgaacagagagattctggtctagcactttggaagatcagctgtattcacatagcactgaagtagcttcctgtataatttcaaggattctgaaaacctggttgaacca

SEQ ID NO: 1402 - DNA, 538 bp, Homo sapiens
  ENST00000463061
aaaaacagagggaaagagtgaaaagacaagaagggcgcaaactgtgacagactcaccgcttcactaactactcacttaaactggaagcaaaatgtccctaaaattgccaaggaactgggatttcaacctgaaagtggaggctgcgaaaatagtaaatgctaaagggagtccttcctgcaggttgatataaaaggacactaaacaataacttgatgccatatgaagaaaaaaagatctcagcaaagatactgactcccacgcaggaaaaaggaagcaccttttgtcagatgctgtggccacttcctcttcagaaggctccagccaacctttcggtttgcagaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctg

SEQ ID NO: 1403 - DNA, 841 bp, Homo sapiens
  ENST00000485700
accatttgcatgttggtctgcagggagcatagtctacttaaaaatggatctcgcagcaaatctgagtttgagggaccatttgcatttaagttggcatgccaggtccaagttctaaaatgctgggagggggttctctttcatttggacaaaacagtgggatggcactccttggtgtgcaggatctggggtacttcggatgatttaaggctacagactacacacaaaactctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacag

SEQ ID NO: 1404 - DNA, 557 bp, Homo sapiens
  ENST00000496266
gtttgagggaccatttgcatttaagttggcatgccaggtccaagttctaaaatgctgggagggggttctctttcatttggacaaaacagtgggatggcactccttggtgtgcaggatctggggtacttcggatgatttaaggctacagactacacacaaaactatactgactcccacgcaggaaaaaggaagcaccttttgtcagatgctgtggccacttcctcttcagaaggctccagccaacctttcggtttgcagaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgat

SEQ ID NO: 1405 - DNA, 2936 bp, Homo sapiens
  ENST00000409030
ccgagccttcagagtgaggcattattttctcctctctcttgtcagatactgactcccacgcaggaaaaaggaagcaccttttgtcagatgctgtggccacttcctcttcagaaggctccagccaacctttcggtttgcagaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 1406 - DNA, 2939 bp, Homo sapiens
  ENST00000409220
ccgagccttcagagtgaggcattattttctcctctctcttgtcagatactgactcccacgcaggaaaaaggaagcaccttttgtcagatgctgtggccacttcctcttcagaaggctccagccaacctttcggtttgcagaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 1407 - DNA, 1362 bp, Homo sapiens
  ENST00000473986
ctcttcagaaggctccagccaacctttcggtttgcagaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagagtggtcctccaggaagcaccaggacgggcactgtggagtttcctacacatggctctgagtcaagactggcaacagggcggtgatggtagtgacactcagtcaagggctcagagagagtggatttgggttcaggaaaaccgattttgggactcattgatttgtttgttcaggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagg

SEQ ID NO: 1408 - DNA, 1843 bp, Homo sapiens
  ENST00000497079
gaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatggtaaggtgcagagaaccttcctgcttccattgggttcttcctttagtccaggccatcccatgtaaggcctgctctcgggtggcaatttggggagttttaggtgatgcagtggcagtgggcgctgctgctacagactcatctgaacacaccttgaaagcctggcctctttccaaatctagtttctattggcatctttgaggggggtgagtgacaagtgtgccaatcacccagtgactgagcaatgaggtcctcactgaagcccactctgaaagagagactcaaatacagtccagagaagttcagtgggaaaaatgtatacaacattgtaaatgttttggtcagaattgttgaaaattctgggtgaacgtccagagaaaactggtttcctgctaacccatgaaacgtgattcctttctcagagta

SEQ ID NO: 1409 - DNA, 2096 bp, Homo sapiens
  ENST00000497259
aagcacagaatgacgggcaggttctgtttgctctctcctcagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtat

SEQ ID NO: 1410 - DNA, 1933 bp, Homo sapiens
  ENST00000479844
attctgggccaccctggttattttccttcagccctttctggggacctgctgtgcgccacccctgtggcaactctagctgtggattgacccagatctggctcggctgggaactgggatcttcatcccagactgacctgaattttgtcttttattttttaaaaataatttgttgtagttcctagattataaaagtcatgcttgcttgacttggaaaccaggaagatatagcaaacagttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 1411 - DNA, 6862 bp, Homo sapiens
  ENST00000274498
ggcggggcggccgaggctgctgtgagagggcgctcgaggctgccgagagctagctagcgaaggaggcggggaggcggcgtctgcactcgctcgcccgctcgctcgcttcccggcgccgctgcgggtccgcgctgcgtttcctgctcgcgatccgctccgttgcccgcgcccggaacagcagcacctcggccgggtccgagctcggttcgggagtcttgcgcgccggcggacaccgcgcgcggagtgagccagcgccacacctgtggagccggcggccgtcgggggagccggccggggtcccgccgcgtgagtgctctgggcggcgggcggcccgggccccggcggaggcgcgccccccggctgggcgccgcgcgcaccatggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttaacaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccaggctggagtgcagtggcgcaatcttggctcactgcaacctccacctcccaggttcaagtgattctcctgtctcagcctcccaagtagctgggactacaggcatgagccatcacacccagctagttttttgtatttttagtaaagatggggttttgccatgtttgccaggctgatctcgaactcctgacctcaagtgatctgcccacttcagacccccaaagtgctgggattccaggtgtgagccgctgcggccgaccacatttgatgtttgaagttgtaatctgtcccatcataaacttacctggagctcatgtggaggaacagaaggccaagatccttgctttgggggtgcctcacgaagcatccctgtagacatttggccccagcttcactgcttggaagcatgtccctccctcttgagttggctctgatttgaaatcgggagaaacagagctgctgccaatgggatcttttaggtaactccctccctagcttccgtgtgtctgtgcagtgcccatgagctgctgccaatgggatctttcaggtaccccctccccagcttccctgtggctgtgcggtgcccttgacagatggcttctctgtttccctttgcccagccaggctcccctccttcctattagctacaaaactggataaacttcagaatatgagccaatgagtaggaaggaacttgaagactaaagattttactctctcccctatccatgccccctacctctgactctctctgtgtgaacaggaaactttagggcagatgaggagaatgaattggttatcagagtggaagaccatggcccaggatccctgagctttcccagtagcctccagtttcctttgtaagacccagggatcacttagccatagcctgaatcttttaggggtattaaggtcagcctctcactcttccttcaggttactaacaaaatttcgtagctaaagaatgccatggccgggtgcagtggctcacgcctataatcccagcactttgggaggccgaggcgggcggatcacgaggtcaggagattgagaccatcctggctacgacggtgaaaccccgtctctactaaaaatacaaaaaattagccgggtgtggtggcgggcgcctgtagtcccagctactctggaggctgaggcaggagaatggcatgaacccaggaggcagagattgcagtgagccaagatcacgcccctgcactccagcctgggtgacagagccagactccgtctcaaagg

SEQ ID NO: 1412 - DNA, 9200 bp, Homo sapiens
  ENST00000378004
gagagggcgctcgaggctgccgagagctagctagcgaaggaggcggggaggcggcgtctgcactcgctcgcccgctcgctcgcttcccggcgccgctgcgggtccgcgctgcgtttcctgctcgcgatccgctccgttgcccgcgcccggaacagcagcacctcggccgggtccgagctcggttcgggagtcttgcgcgccggcggacaccgcgcgcggagtgagccagcgccacacctgtggagccggcggccgtcgggggagccggccggggtcccgccgcgtgagtgctctgggcggcgggcggcccgggccccggcggaggcgcgccccccggctgggcgccgcgcgcaccatggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttaacaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccaggctggagtgcagtggcgcaatcttggctcactgcaacctccacctcccaggttcaagtgattctcctgtctcagcctcccaagtagctgggactacaggcatgagccatcacacccagctagttttttgtatttttagtaaagatggggttttgccatgtttgccaggctgatctcgaactcctgacctcaagtgatctgcccacttcagacccccaaagtgctgggattccaggtgtgagccgctgcggccgaccacatttgatgtttgaagttgtaatctgtcccatcataaacttacctggagctcatgtggaggaacagaaggccaagatccttgctttgggggtgcctcacgaagcatccctgtagacatttggccccagcttcactgcttggaagcatgtccctccctcttgagttggctctgatttgaaatcgggagaaacagagctgctgccaatgggatcttttaggtaactccctccctagcttccgtgtgtctgtgcagtgcccatgagctgctgccaatgggatctttcaggtaccccctccccagcttccctgtggctgtgcggtgcccttgacagatggcttctctgtttccctttgcccagccaggctcccctccttcctattagctacaaaactggataaacttcagaatatgagccaatgagtaggaaggaacttgaagactaaagattttactctctcccctatccatgccccctacctctgactctctctgtgtgaacaggaaactttagggcagatgaggagaatgaattggttatcagagtggaagaccatggcccaggatccctgagctttcccagtagcctccagtttcctttgtaagacccagggatcacttagccatagcctgaatcttttaggggtattaaggtcagcctctcactcttccttcaggttactaacaaaatttcgtagctaaagaatgccatggccgggtgcagtggctcacgcctataatcccagcactttgggaggccgaggcgggcggatcacgaggtcaggagattgagaccatcctggctacgacggtgaaaccccgtctctactaaaaatacaaaaaattagccgggtgtggtggcgggcgcctgtagtcccagctactctggaggctgaggcaggagaatggcatgaacccaggaggcagagattgcagtgagccaagatcacgcccctgcactccagcctgggtgacagagccagactccgtctcaaaggaaaaaaaaaaaaaaaaaaaaagaatgccatgccaggagaagacagctggtttcaaatccctgcccccaggcaagtaaaaccctgacttgctcaagacagaagatcttttctcctgtttttcaaaataaacatatatagggatggaccctgtgcattgtggcctgccttggtgtcctagaattggagccagtctttagcttaatgtctgaagtatttatacggccaatatgtgttttcttatgtcagaccacactgtctttttgaatatcagttcatttcctctcaccgagtgcttttcggtgagaggcaaagagaaagaatgaacaatcaagtattgacagactggcattagcaggacagagccatactagtgacaagggcatcccaaggcacttgcccagagctgcagagttgtgtgtgccatacctgcggctcaaagggaaggccttctatcccctgagtttctatcagctgaaaatggcaactgctgtctcagtaaaagctctgtcttgactgcagaggctccaaaagcattcacagttgagggggagaaagacagaaagaagaagccaaagataacctgatccctgcctgtctgttggcacctgtcatcctctggcttctgctcccaaaagcaagtctggatgactgagttttgtggacatggcactcccggagacagcagtggccaccatggcacccagagtttgcccaagtactgaatgttttgtgagcaaccatgttccccaagtaggtagccagcgctgcagaaaccaaacagcctcttagctacctgactttaaaaggaatgacctaggtgttctgccaaaggagttatctatcatctctggcaaacttgacaatcatcacttacctcgacaaccctgccccacatcactttataaagtcagcaggatgtcttctcacccaccctgtgctggtgtctaacaaatttatcttgtcatgctcaaatgtgtttggcagccacaccgatcggctgggtgctgaaccgcctctctgtaattgtagcatcaaaatgacaacagcagcagagcagcgaatcttgcacagccccacagcatgcctgagacaagactccaacaagtaataattagctttttttctcctgccgcctacagtacctgtctaactaaagagcttcccaaagtggagggaaaggccatagaatccaggtgtcattcagagccagtccttgctgaaatgtggtcttccagtggaagcacctgtattattgagaggaaaaagtgttggatgcaaagtaacaccaggactagagagaaagagaaaggtgaaccatcctaaggagctttggatacttttttagaaggataaatattatgcttactgaggagaaaaaaaaaagcgatcacagaaaaatttcacagctaatatttttacaaaagttgtgccagacattacagagtgaaaacgtctctcaaggtggaatgctttagagagcaaaggcttagcatagacctagacccttgtgtgggtatgacatgacatgacatgtccatgtcaaaattcactttagtcagaaccagagtattgataaacaaaatgtcagttacctggagcagtcctggagaggttaagacattctatactgttctacgtcaaccatttctacaaagttgtccagacacctaaaagcagctttcttggttatccagatgccagaatcaaccttgtatctgacaatgcacatctgttgattctaaagtatatttatgtgtgtgtgtatgtgtgtgtatacagcacatatttacatctatgaagacatagacacttacagagacccacatgagctggcactttctgagcctttacagcctttaagactcggaggttgagaattagagacacaagagaggctgtggatggcctattaaaatgattaaagatgtaaattcagtgccattttaaaactgttcatatttatcaaacaattactgtctacagctacattttttgttaacttacttaaagtcatgtcgcaagaaagatcaaacccatgaatgcttagtagctaaggctagtgttcaaaagcactctaaaagacattttgtccacattttggaaaagaaaatatttgcatgtttaattcataatttaggctatctttgagtatactgtaaagtgctgtgtgatataatatcaataaagtacttattaaatggcactttaatgttttcttttaaaataacgcactgttctaaacttcagtattgactattgactcgtgcatagaatccaatgctgtaattagaaagtaatctgtgactagaatagacctttgtccctgttagtagccctgttgccatgttcaggcttttaaaaaatgcttttgtgtcaccaaatatatctataaagaaaacaaaatttctgttcagaggcctctgaaacttggctttcttacatgtggttggtttatgtgacaatccctatgaaatgagtggacgtatgatttttgaattaaatgacttttccatttggtggtatttt

SEQ ID NO: 1413 - DNA, 564 bp, Homo sapiens
  ENST00000378013
agccagagatggagtccctgccagtgcagagctcttgacttctgccccatctcacttgcccggaatggaacctcttgcaccaagccctagaatttggacttgtgttttctattttggcattgaatctgaggaggatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttga

SEQ ID NO: 1414 - DNA, 643 bp, Homo sapiens
  ENST00000475287
attccctagctagagtgccaggtggaattaacctgcatttctgggtcatccttaatggttaatgattaaaaagatgaagggagccttgggaagcaattgactttaggcatctgtatgtgccaaggaattaaaatccataacataatagccagagctggaaaggctccccaaggcccatgacactccttccacctcatggcccctttctgttttccagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaaga

SEQ ID NO: 1415 - DNA, 910 bp, Homo sapiens
  ENST00000477867
acaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacagggaagagacccaggaaaactgaagattggtgaaagtcagaatagtggaggccagaaagatttttgaaagatctgaagaatctactggaaccctcagcaccctcatttcaaatatgtttgtatggcaggctgcatgatgcaggtaaaaaagataagagcattcctaaatttgaatttgggatctgttccttactagctgtgtgactctgggtaagtggtttaaccacatctgtaagatggggtgaattatcactacattgcaggattttttctgaaggtggaacacactaatattcccctctgatggagtcctatgtctgaaaacatggctgttgaatttttttctataccctaaaacctggggctttattgttgtgatggtgaaccttagctttggtggatattcctgtgagcctgctttttgtcttaatggtgctccttttcctgtagtgtcatgagttttcaagttatctataagctgagaggaaatacaggtgcattcgggttatatgtgcaaagggcctgctagggtaagattccattttcaaactgtgtatgtgataacctgttgttgatacatgcttc

SEQ ID NO: 1416 - DNA, 527 bp, Homo sapiens
  ENST00000451259
tttctgcgttctctcctcaatcatcttactcctgtcagtgaagagagtggaaacttcagttggggcttgatgatgggaacggggattagtttccccagggaacctttacttccgttgtattttaagacccactggatgtagcatcaatgggaaacagtcttctttggtccctgggggaaatcccggggtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcag

SEQ ID NO: 1417 - DNA, 566 bp, Homo sapiens
  ENST00000461314
gaagagagtggaaacttcagttggggcttgatgatgggaacggggattagtttccccagggaacctttacttccgttgtattttaagacccactggatgtagcatcaatgggaaacagtcttctttggtccctgggggaaatcccggggtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacagtggagacggaatttcaccgtgttggctaggctggtcctgaactcctgacctcaagtgatccacccaccttggcctcccaaagtgctgggattacaggcatgagccgccacgcctggcctgaatctcctcttaatgaacaggaggccaggggttatcaccatgcaagctttgtcggaagaggaccggaggctctggatggaagccatggatggccgggaacct

SEQ ID NO: 1418 - DNA, 667 bp, Homo sapiens
  ENST00000469131
acttctaacatagtttaagggtagggtagatgagcattatgaattatgggttgtggtttttccagctcatgatgtatagcatacagtggaatgtatagatattttatgggaaatattacctttcaggtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaag

SEQ ID NO: 1419 - DNA, 513 bp, Homo sapiens
  ENST00000469396
attgtaggaaaagcacgtggcatagaaggtgatatgtagctatctttggaagagacagttgggcacatatggctccctggtgtccccgccattgggcagctccttgaatgctcctagttcttccctcctcctggctgttgcctctcgcctcctgcctgcttggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatgg

SEQ ID NO: 1420 - DNA, 556 bp, Homo sapiens
  ENST00000464838
cccaggaaaccttgaaagagagtaatttggcacaaattcatctcctaatgaaggagggctggaagtcctgcattttactattccttctggattttgccagctataaatagaagcaaggttcccttggatagaatgtttgaatttactaggagaaatgcagggatcaaggatggctgaagaaaaatacttgccaaagtgtggtcttctcttctgcacttcccttgcccaactttccaaggtctacaactcgaacaaagacagccagagtgaagggagtaagtacgatgcttgggtaaccttctacagccagggttgggagtaggctttgagaagttgctactccaggtgtgaaccaccaggcggtgctgtgggcgtgttgggttggctccagttcccgagtgcagtgggacatgcctccaccccaactttccgccagtgactccagagggacggtaagtgagcctggctggcaaggctgtagtgtagtgacaccttgcattgaaataatgggtcacactttacaaagcattctcgtgtacattatctcctttaatcg

SEQ ID NO: 1421 - DNA, 293 bp, Homo sapiens
  ENST00000470032
gtctacaactcgaacaaagacagccagagtgaagggactgcgcagttggacagcattggcttcagcataatcaggaaatgcatccatgctgtggaaaccagagaactcttcagatgctgcctttggcaagagaaaggaaagcttctttcgccgctgatgactgaactaacatgagggctgaagtgtgcagcacatccgtgaaatcctagacagctgtaccaaatcccactcgtttgctaagagctgagctgagtgacaggggactttaattagagcagcttttaggaggactg

SEQ ID NO: 1422 - DNA, 2870 bp, Homo sapiens
  ENST00000443674
ctgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggccagaagaagcggtacatgaagactccagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttg

SEQ ID NO: 1423 - DNA, 1632 bp, Homo sapiens
  ENST00000418236
accccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaa

SEQ ID NO: 1424 - DNA, 412 bp, Homo sapiens
  ENST00000443045
gcaaaactggagaaccaggagtctcgggtctctgaaatccacagccttgttcatcggctcccagagaaaaatcggcagatgttacagctgctcatgaaccacttggcaaagtatgctggaggcttaggaaagaaatgtgtgaaatgttcattgcagtggagaacagcagcaaatgccagatggccttcccagaggatgctggggaagtgctcatgcaaccaggccaccaagcagagttttcagggggattttacctatggtgatcaagggcaaattggagtgtgttgtccatgataccaggtcaccacacagaattttgtgggattatatgttcttatgctcatcaagaacaaacaaaaatatgttgtgggtttacagaatttgggtttttagtaaagaggactggattcta

SEQ ID NO: 1425 - DNA, 565 bp, Homo sapiens
  ENST00000419676
attgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcacttgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggc

SEQ ID NO: 1426 - DNA, 559 bp, Homo sapiens
  ENST00000424007
gtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactgcactggggatttggaatgtgtttggagggttgtactgaggtgcagagtcctgcttcgtgatgggcacaagggttcatgcgagttcagcaagcagttaccatgtctacggcatgccaggatactgttgggaaggtagtattccgttgttcagcctcctcgtcaactttgttccctgccatccaaacctgcacttgctttttgacaggccagaagaagcggtacatgaagactccag

SEQ ID NO: 1427 - DNA, 407 bp, Homo sapiens
  ENST00000489924
gatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactgtaagtatgatgtccagctgcctaccccacaagggctttggtcagccattccacctagaatttgctgtctggctccatctgactttggaccattatcccctgaacattatttaaacctcctccctaaactgggag

SEQ ID NO: 1428 - DNA, 4752 bp, Homo sapiens
  ENST00000486650
aatcagtgtgtcgggcctcaaaagagaagagcaatgtgatttcatgtagaaccctatttgtatgctgccacagccctatgctttgctttacttcggattcatatagaaatccaagaatttgtagtaagtaagagaaagaaaacaccatctctgctcagctgagctggcccgtgtgccgaactaggaagatggctcttttcctctggagaggatatgatcttttcaaggttgctttttacacatcaccatggggctggcctggttgcatgctgaagctgtgaaacctgagtgtgtatctgtgcaaagctggggtcgaatcagggcccctaggggccctgcactggttttgttgagtggaacatacaggttggggtttttggaggctgggtggggaagagggaggagagatgagggtgttgtcagtgagggaggaactttggggaacagaaatatctaaaaggaagtttaatggactttcttgtacacggtgcataatgtgaatcctcgtccatgtcacctcatgcgggcttcgcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttaacaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccaggctggagtgcagtggcgcaatcttggctcactgcaacctccacctcccaggttcaagtgattctcctgtctcagcctcccaagtagctgggactacaggcatgagccatcacacccagctagttttttgtatttttagtaaagatggggttttgccatgtttgccaggctgatctcgaactcctgacctcaagtgatctgcccacttcagacccccaaagtgctgggattccaggtgtgagccgctgcggccgaccacatttgatgtttgaagttgtaatctgtcccatcataaacttacctggagctcatgtggaggaacagaaggccaagatccttgctttgggggtgcctcacgaagcatccctgtagacatttggccccagcttcactgcttggaagcatgtccctccctcttgagttggctctgatttgaaatcgggagaaacagagctgctgccaatgggatcttttaggtaactccctccctagcttccgtgtgtctgtgcagtgcccatgagctgctgccaatgggatctttcaggtaccccctccccagcttccctgtggctgtgcggtgcccttgacagatggcttctctgtttccctttgcccagccaggctcccctccttcctattagctacaaaactggataaacttcagaatatgagccaatgagtaggaaggaacttgaagactaaagattttactctctcccctatccatgccccctacctctgactctctctgtgtgaacaggaaactttagggcagatgaggagaatgaattggttatcagagtggaagaccatggcccaggatccctgagctttcccagtagcctccagtttcctttgtaagacccagggatcacttagccatagcctgaatcttttaggggtattaaggtcagcctctcactcttccttcaggttactaacaaaatttcgtagctaaagaatgccatggccgggtgcagtggctcacgcctataatcccagcactttgggaggccgaggcgggcggatcacgaggtcaggagattgagaccatcctggctacgacggtgaaaccccgtctctactaaaaatacaaaaaattagccgggtgtggtggcgggcgcctgtagtcccagctactctggaggctgaggcaggagaatggcatgaacccaggaggcagagattgcagtgagccaagatcacgcccctgcactccagcctgggtgacagagccagactccgtctcaaagg

SEQ ID NO: 1429 - DNA, 783 bp, Homo sapiens
  ENST00000421521
ccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataacgcagagtgtccttcagcttccacagccatcttcactgccacaccgaagctccgggcacctccacctctcacctgggcacttccactggccgcctgacacatcttctcacatctgctcttgctgccataaccccctctttacagagcagcgagagtgatctttgaaaaacggaaatggcattaaagcccttcagtggcctcccattgctctgagaattacttacaaggccctccagggcccagttcctgcccctctgacctcacgccctcacttgacatactacagcctcatgccttcttcatgttctcaagcaaggtcggcaaactatgacctgcccgtcaaatccaacctgccacctgtcacctaacaattctgtaactgctcccacatacaacatggtcgtcatcataaatcct

SEQ ID NO: 1430 - DNA, 785 bp, Homo sapiens
  ENST00000425417
ccccgaatccaagcccaacttcacccctctcgccatcttggcccatgttctcggcgccatccagccctatgcccacctcatccacgtccagcgactcatcccccgtcagcacaccgttccggaaggcaaaagccttgtatgcctgcaaagctgaacatgactcagaactttcgttcacagcaggcacggtcttcgataacgcagagtgtccttcagcttccacagccatcttcactgccacaccgaagctccgggcacctccacctctcacctgggcacttccactggccgcctgacacatcttctcacatctgctcttgctgccataaccccctctttacagagcagcgagagtgatctttgaaaaacggaaatggcattaaagcccttcagtggcctcccattgctctgagaattacttacaaggccctccagggcccagttcctgcccctctgacctcacgccctcacttgacatactacagcctcatgccttcttcatgttctcaagcaaggtcggcaaactatgacctgcccgtcaaatccaacctgccacctgtcacctaacaattctgtaactgctcccacatacaacatggtcgtcatcataaatcctataggtattgttgagagcaggaggaaagtttggttgagtgagtgagagaccttacccaagccttcctgtggtctctaggagtcatggcagagttcgctgacactggtctgcttttaaccagccttgccagtgacctttcaaattccctgaggagcaaaaggccaaattg

SEQ ID NO: 1431 - DNA, 1807 bp, Homo sapiens
  ENST00000546444
accatttttttccgagaatgaatagcagaatttccctgtataaaaagtccaagaatagaagccaattttaaattaaagctaaaatagtatgacttttattattctgaaaatgttgtcattccccatttccaaaataatacaatgaataatcagaagagctgtatccatgtttttcttttaggagactttaatacaaaattaccgtgtacttcatctacaatatgtcttctgctgctgatctagatctgagctgtccgatacagctgccagaagccacaggtgacgttatattcctattcgaagaccaagagctcaaaacatcattcctcccccaaatgaaaaaatgtctgggaaaaattactaatctacttctctgaaacccatttgggaagctggcccaattcgagttctatactcaaaaggcaaacgtaaagactaaacctgtaagtgtgcctgtatgtagatgacttcttacaagacctcctaatgagagtaatggcagaaataggggaaatgaaaattaagacaagttttgcaagtgttattccaaagaatccagaatatttccattttgcccatggtgaaactatccaaggaaggttaagtaatttggattggtcaggatgtgaacctaggccagtctgacttttaagcctgtgatttttctgttatcccatgacatggtgtacactacaagaaatgctaatcttaataacatagctacctgtattgagagctcattaggtccggtactgttctaagcactttgcttctatctctcactcagcatattttagtgagctctttattgatttacaagattatgcatctatgaactcagtcacactggctattaattaaattcccttcaagtttgtaaaaaattaattgacatttcattcttttttcagaagacaccaggtttttagccttggatcaagatgtctcaaaaaaaattcagtaaaaatctagatcttgctcagctccaaattcttgtactgctttcagagtactgagatcattgtagcccaaacatgcaatggcattttataagcctcttgaactctgaggactaagctctgattttttttaatcttgtccaaattcctatctaaggggtctggggagtcatgcactacaaaccataaattctcatcagatgggttttatttaaccctatatatcatgacttacttgccaacctgactctggcataacattatcagacaaggaagaaaatcaaaatattttaccccaaaacatgtttatttgccatatcttgaaatggccctgcaaagctgtcttttgtgggggaaaatttgcctctgtaaagaatctctattaacataactagatctttttcttccaggccctcccaaacctaaggagattaactaaaagtctagcacttcttaaagatctgaataggaaacatttcaactattatctctaagggcagccactataagacttcaaaagaaccttggtctccacaatcttttatcttaacctgaacctttcccttctatcaatcccaggtctttagacaaactcaaccaattgtcaatcagaaaatatttaaattcacctgtagcctggaagcccctgctttgagttgtcccatccttctagaccaaacgaatgtatttcttaaatgtatttgattgatgtctcatacctccctaaaatgtataaaaccaagctgcatccccaactaccttgggcacatgttctaaggacctcctgagggctgtgtcatgggccatggtcactcatatttggctcaaaataaatctctttgaatatt

SEQ ID NO: 1432 - DNA, 3439 bp, Homo sapiens
  ENST00000552844
agaacccctggtaggttaatccaggcttacccacttgctctacatgctgctctttgggatttcagtttttctgactgttacatgaaaggatgattgctcacaaacagaaaaagacaaagaaaaaacgtgcttgggcatcaggtcaactctctactgatattacaacttctgaaatggggctcaagtccttaagttccaactctatttttgatccggattacatcaaggagttggtgaatgatatcaggaagttctcccacatgttactatatttgaaagaagccatattttcagactgttttaaagaagttattcatatacgtctagaggaactgctccgtgttttaaagtctataatgaataaacatcagaacctcaattctgttgatcttcaaaatgctgcagaaatgctcactgcaaaagtgaaagctgtgaacttcacagaagttaatgaagaaaacaaaaacgatctcttccaggaagtgttttcttctattgaaactttggcatttacctttggaaatatccttacaaacttccttatgggagatgtaggcaatgattcattattgcgactgcctgtttctcgagaaactaagtcgtttgaaaatgtttctgtggaatcagtggactcatccagtgaaaaaggaaatttttcccctttagaactagacaacgtgctgttaaagaacactgactctatcgagctggctttgtcatatgctaaaacttggtcaaaatatactaagaacatagtttcatgggttgaaaaaaagcttaacttggaattggagtccactagaaatatggtcaagttggcagaggcaactagaactaacattggaattcaggagttcatgccactgcagtctctgtttactaatgctcttcttaatgatatagaaagcagtcaccttttacaacaaacaattgcagctctccaggctaacaaatttgtgcagcctctacttggaaggaaaaatgaaatggaaaaacaaaggaaagaaataaaagagctttggaaacaggagcaaaataaaatgcttgaagcagagaatgctctcaaaaaggcaaaattattatgcatgcaacgtcaagatgaatatgagaaagcaaagtcttccatgtttcgtgcagaagaggagcatctgtcttcaagtggcggattagcaaaaaatctcaacaagcaactagaaaaaaagcgaaggttggaagaggaggctctccaaaaagtagaagaagcaaatgaactttacaaagtttgtgtgacaaatgttgaagaaagaagaaatgatctagaaaataccaaaagagaaattttagcacaactccggacacttgttttccagtgtgatcttacccttaaagctgtaacagttaacctcttccacatgcagcatctgcaggctgcttcccttgcagacagtttacagtctctctgtgatagtgccaaactctatgacccaggccaagagtacagtgaatttgtcaaggccacaaattcaactgaagaagaaaaagttgatggaaatgtaaataaacatttaaatagttcccaaccttcaggatttggacctgccaactctttagaggatgttgtacgccttcctgacagttctaataaaattgaagaggacagatgctctaacagtgcagatataacaggtccttcctttataagatcatggacatttgggatgtttagtgattctgagagcactggagggagcagcgaatctagatctctggattcagaatctataagtccaggagactttcatcgaaaacttccacgaacaccatccagtggaactatgtcctctgcagatgatctagatgaaagagagccaccttccccttcagaaactggacccaattcccttggaacatttaagaaaacattgatgtcaaaggcagctctcacacacaagtttcgcaaattgagatcccccacgaaatgtagggattgtgaaggcattgtagtgttccaaggtgttgaatgtgaagagtgtctccttgtttgtcatcgaaagtgtttggaaaatttagtcattatttgtggtcatcagaaacttccaggaaaaatacacttatttggagcagaattcacacaagttgcaaaaaaggaaccagatggtatcccttttatactcaaaatatgtgcctcagagattgaaaatagagctttgtgtctacagggaatttatcgtgtgtgtggaaacaaaataaaaactgaaaaattgtgtcaagctttggaaaatggaatgcacttggtagatatttcagaatttagttcacatgatatctgtgacgtcttgaaattataccttcggcagctcccagaaccatttattttatttcgattgtacaaggaatttatagaccttgcaaaagagatccaacatgtaaatgaagaacaagagacaaaaaagaatagtcttgaagacaaaaaatggccaaatatgtgtatagaaataaaccgaattcttctaaaaagcaaagaccttctaagacaattgccagcatcaaattttaacagtcttcatttccttatagtacatctaaagcgggtagtagatcatgcagaagaaaacaagatgaactccaaaaacttgggggtgatatttggaccaagtctcattaggccaaggcccacaactgctcctatcaccatctcctcccttgcagagtattcaaatcaagcacgcttggtagagtttctcattacttactcacagaagatcttcgatgggtccctacaaccacaagatgttatgtgtagcataggtgttgttgatcaaggctgttttccaaagcctctgttatcaccagaagaaagagacattgaacgttccatgaagtcactatttttttcttcaaaggaagatatccatacttcagagagtgaaagcaaaatttttgaacgagctacatcatttgaggaatcagaacgcaagcaaaatgcgttaggaaaatgtgatgcatgtctcagtgacaaagcacagttgcttctagaccaagaggctgaatcagcatcccaaaagatagaagatggtaaaacccctaagccactttctctgaaatctgataggtcaacaaacaatgtggagaggcatactccaaggaccaagattagacctgagactttaatacaaaattaccgtgtacttcatctacaatatgtcttctgctgctgatctagatctgagctgtccgatacagctgccagaagccacaggtgacgttatattcctattcgaagaccaagagctcaaaacatcattcctcccccaaatgaaaaaatgtctgggaaaaattactaatctacttctctgaaacccatttgggaagctggcccaattcgagttctatactcaaaaggcaaacgtaaagactaaacctaagacaccaggtttttagccttggatcaagatgtctc

SEQ ID NO: 1433 - DNA, 6087 bp, Homo sapiens
  ENST00000260526
gctgtggctgcggctgcggctgcggctgagatttggccgggcgtccgcaggccgtgggggatgggggcagcgagctccagccctcggcggtggcggcggccgtaggtgtggggcgggcgtccgcgtccggcacgcgagatggagcgccgtggatttcagtttttctgactgttacatgaaaggatgattgctcacaaacagaaaaagacaaagaaaaaacgtgcttgggcatcaggtcaactctctactgatattacaacttctgaaatggggctcaagtccttaagttccaactctatttttgatccggattacatcaaggagttggtgaatgatatcaggaagttctcccacatgttactatatttgaaagaagccatattttcagactgttttaaagaagttattcatatacgtctagaggaactgctccgtgttttaaagtctataatgaataaacatcagaacctcaattctgttgatcttcaaaatgctgcagaaatgctcactgcaaaagtgaaagctgtgaacttcacagaagttaatgaagaaaacaaaaacgatctcttccaggaagtgttttcttctattgaaactttggcatttacctttggaaatatccttacaaacttccttatgggagatgtaggcaatgattcattattgcgactgcctgtttctcgagaaactaagtcgtttgaaaatgtttctgtggaatcagtggactcatccagtgaaaaaggaaatttttcccctttagaactagacaacgtgctgttaaagaacactgactctatcgagctggctttgtcatatgctaaaacttggtcaaaatatactaagaacatagtttcatgggttgaaaaaaagcttaacttggaattggagtccactagaaatatggtcaagttggcagaggcaactagaactaacattggaattcaggagttcatgccactgcagtctctgtttactaatgctcttcttaatgatatagaaagcagtcaccttttacaacaaacaattgcagctctccaggctaacaaatttgtgcagcctctacttggaaggaaaaatgaaatggaaaaacaaaggaaagaaataaaagagctttggaaacaggagcaaaataaaatgcttgaagcagagaatgctctcaaaaaggcaaaattattatgcatgcaacgtcaagatgaatatgagaaagcaaagtcttccatgtttcgtgcagaagaggagcatctgtcttcaagtggcggattagcaaaaaatctcaacaagcaactagaaaaaaagcgaaggttggaagaggaggctctccaaaaagtagaagaagcaaatgaactttacaaagtttgtgtgacaaatgttgaagaaagaagaaatgatctagaaaataccaaaagagaaattttagcacaactccggacacttgttttccagtgtgatcttacccttaaagctgtaacagttaacctcttccacatgcagcatctgcaggctgcttcccttgcagacagtttacagtctctctgtgatagtgccaaactctatgacccaggccaagagtacagtgaatttgtcaaggccacaaattcaactgaagaagaaaaagttgatggaaatgtaaataaacatttaaatagttcccaaccttcaggatttggacctgccaactctttagaggatgttgtacgccttcctgacagttctaataaaattgaagaggacagatgctctaacagtgcagatataacaggtccttcctttataagatcatggacatttgggatgtttagtgattctgagagcactggagggagcagcgaatctagatctctggattcagaatctataagtccaggagactttcatcgaaaacttccacgaacaccatccagtggaactatgtcctctgcagatgatctagatgaaagagagccaccttccccttcagaaactggacccaattcccttggaacatttaagaaaacattgatgtcaaaggcagctctcacacacaagtttcgcaaattgagatcccccacgaaatgtagggattgtgaaggcattgtagtgttccaaggtgttgaatgtgaagagtgtctccttgtttgtcatcgaaagtgtttggaaaatttagtcattatttgtggtcatcagaaacttccaggaaaaatacacttatttggagcagaattcacacaagttgcaaaaaaggaaccagatggtatcccttttatactcaaaatatgtgcctcagagattgaaaatagagctttgtgtctacagggaatttatcgtgtgtgtggaaacaaaataaaaactgaaaaattgtgtcaagctttggaaaatggaatgcacttggtagatatttcagaatttagttcacatgatatctgtgacgtcttgaaattataccttcggcagctcccagaaccatttattttatttcgattgtacaaggaatttatagaccttgcaaaagagatccaacatgtaaatgaagaacaagagacaaaaaagaatagtcttgaagacaaaaaatggccaaatatgtgtatagaaataaaccgaattcttctaaaaagcaaagaccttctaagacaattgccagcatcaaattttaacagtcttcatttccttatagtacatctaaagcgggtagtagatcatgcagaagaaaacaagatgaactccaaaaacttgggggtgatatttggaccaagtctcattaggccaaggcccacaactgctcctatcaccatctcctcccttgcagagtattcaaatcaagcacgcttggtagagtttctcattacttactcacagaagatcttcgatgggtccctacaaccacaagatgttatgtgtagcataggtgttgttgatcaaggctgttttccaaagcctctgttatcaccagaagaaagagacattgaacgttccatgaagtcactatttttttcttcaaaggaagatatccatacttcagagagtgaaagcaaaatttttgaacgagctacatcatttgaggaatcagaacgcaagcaaaatgcgttaggaaaatgtgatgcatgtctcagtgacaaagcacagttgcttctagaccaagaggctgaatcagcatcccaaaagatagaagatggtaaaacccctaagccactttctctgaaatctgataggtcaacaaacaatgtggagaggcatactccaaggaccaagattagacctgtaagtttgcctgtagatagactacttcttgcaagtcctcctaatgagagaaatggcagaaatatgggaaatgtaaatttagacaagttttgcaagaatcctgcctttgaaggagttaatagaaaagacgctgctactactgtttgttccaaatttaatggctttgaccagcaaactctacagaaaattcaggacaaacagtatgaacaaaacagcctaactgccaagactacaatgatcatgcccagtgcactccaggaaaaaggagtgacaacaagcctccagattagtggggaccattctatcaatgccactcaacccagtaagccatatgcagagccagtcaggtcagtgagagaggcatctgagagacggtcttcagattcctaccctctcgctcctgtcagagcacccagaacactgcagcctcaacattggacaacattttataaaccacatgctcccatcatcagtatcagggggaatgaggagaagccagcttcaccctcagcagcagtgcctcctggcacagatcacgatccccacggtctcgtggtgaagtcaatgccagacccagacaaagcatcagcttgtcctgggcaagcaactggtcaacctaaagaagactctgaggagcttggcttgcctgatgtgaatccaatgtgtcagagaccaaggctaaaacgaatgcaacagtttgaagacctcgaaggtgaaattccacaatttgtgtagggatgtcaaatttcagggtttttttgttgttgttgtgttattttgtggtattgtgcttgttttgtgaaagaatgttttgacagggcctcttttgtataggactgccaaatcatgggttttgccttttgttgttgtatttatcctctgttggtaatactgaatggtagaatgttttgatagggtcacatttgtgcctcactggaattatctttaaattctgtatttttaaagttgtgaataagataggtggattcgtattttttaaagttcagttgactttccccaccaaatggtccatttgaatgcatccctaatatatgatatagtctcaactaataggtgcaatttgggaaaatcaggtttattttttggagtggaactgttataagtgcttatttataaaaggaatgtttctgaatgcaagtgcctaaaaagatctttgttggtatgcatatgttttgtcacacaattttatagtgcatctttcaccatttgtgcttttttaagatacgtatgtaagctcttatttttcaattggcaattcagttaatttttaaatgtttacataatggccagaaggcttgcaaatctgtatttaattgcattttaattaattgccagtttttacatgtgatagtcagttgtacaaagaaaatgcacttaaacctgtttctaaattatatattcagttatattatatttggctttagatggttttaatacatttgatagtttttcaccccttggctttattttatataaacttttgtttttcagcagttctgaactttttagtattttataaatggtccaaaaaatgcctgtttcagaagtttttgaattcagtgcatttcctcttgatttgtctgggttaaaaccattccttttgtatgaaatgttttgacttaggaatcattttatgtacttgttctacctggattgtcaacaactgaaagtacatatttcatccaaatcaagctaaaatttatttaagttgattctgagagtacaggtcagtaagcctcattatttggaatttgagagaaggtataggtgatcggatctgtttcatttataaaaggtccagtttttaggactagtacattcctgttattttctgggttttatcattttgcctaaaataggatataaaagggacaaaaaataagtagactgtttttatgtgtgaattatatttctactaaatgtttttgtatgactgtgttatacttgataatatatatatatatatatatcaacttgttaaattatttcatgttcccgtggcttcttttcagttgttgcctattacagtatgagagtttaaggttattaaccattggcttagaagtcaacacctaggatcatacatccgttgactacaatgtggaatgaattttatggaaacctgttttatagttctatgtgatgtaaaggtctagggagcaataaccagcccttttttttctgaaggcttgtttttagtcctcattgtacaaaatataaaataatcatattgctatgaatacctaaaaagaaaattagagcccatgtgtattgagccttctctgtgtgccaggaactttgccaaggtgctacatagattattttatttcaagttcacagcaacctataatgggtgggtaagcatgttattatttctgtgttacagataaggaaactaaggcttagttaaatgacttgcttcagtgttccacaggtgtaacaggtggagtcaaatctcaaacatagggctgtcagattttgatggttagtgctcttaatgactgtgattactaaataatatctggtagtttttaacaatagaaaatgcaactttaaaaaatttttattgtggtaaaatacacataacatttaccatttttaagtatattgtttgaaccatttttaagcatatagttcagtggcattaagtatattcacattgttttgcaaccatgagcacctattcatctccagaacattatcatcatcctatactaaaacttagaaaatgtacttttaaacttcttcagttctcttttaatatatggagcccacccaaaggttatatcatgtaataaactcatttctctgttttccctcacagcttaaaaa

SEQ ID NO: 1434 - DNA, 8480 bp, Homo sapiens
  ENST00000482481
gtatattgatccttttatccctagaaatgtgtctctttttatactgataaattcccttgctttttattttactttatttaatactgatatgttattccagttttcttttggttattttgagtgtagcatatcttttatcattcttttaattttatcatatttaaagtgagtttcttatatagcattatagagagcatatacttctattgtgattttttttaaaaatctattttggcactatcttataagtggagtgtttagaccatttatatttaaggtaaatatatgttcagatttagttttatcattttatttcttttttgtttatgccttatgatattttccttaatctatttcccttttgctgccgtcttttggatgaattgatacttttctagacatatattttaatttgtctactgggttttttattatgtatcttcatataccttttttaaaaaattggttgcacacatctgtgttattaagaagctatagtagctcaggttatattcctaacttttaaatgttttctgaagaaaacattgtgaaggaaaaaacagtgtggatgctcataacacctcccctggcaccactgtcataaactgaatattgcttgcaatgtcttggattcactgtcaattgaatattgggttgcctggcccatgggtccaatcaccagaatggtttttttcccctttgttcttataaaatgagagaaaagtttaataaatgaaccaaaactgagattttgtttggtagaactctttcccttcccttctcgttctaatgactacagtgtctttttcaagagaatatagcagttacaaaccactcctggccagcttccagttaggaaattcaatttttatctttttatataacccgagaaaatctccctctaattatcatttagaaacttgcattgccttgataaccacaatggttgcatgtagacttctattattactttttacttttgtctacatttactctcagtgaagctaaatgtaaaactacatcgcttgaccaatgaaaaaatgtgtttgattgtttatgtcatatagagtcaaccagttaagcagcatatatcaaaacataatggtttttgagatcatttagcattgtaaattctcattagaacctcacaatcttggttgaatctttggtatttatctgtttaagacttggttgaactgagttgctatggactgcttatgaccccctgcaaaattagcatgttgagttcctaatccccagtgtgatgatgtgatgatatttggagggtggggcttttgggaggtgactaggtggagccctcatgacccttccccttctatcatgtgaggacacagagagaaaagaacagtctacgcatcaggaattggggcccacaccagaccctgaatctgatagtgccttggtcttgatctctcaatctctacaactgtgagaaataaatctttgttaagtcactctgtggtatttttgttgtagcagcctgatgtgactaagaacatacagatgtagtagtacatatatggattctgtcatatatgaaaatggatattgtgtcattaagatacaaaataagcattctggtaaaaaaaaaattatctctttcatggaacagaaatagaagttctgagattactagttacctgaaagtgtagtaatgaactgtgaaaaactgttgaagaagccgagcatttaatgtggcttccagagttttatgaaaatgctagatgcattaaaacatgtactaggacaattcagcctaaaatagattattctataaatagccaagtttaaaaaaaatggttgcacacttatctatatttatacatacacttaatttttttacagtctacttagaactagttttttaccacttcaagtggaacacagaagcatcaccaccgtagaagttcctttacctaatctgggttgtatttgatatatgtaaattacatccatatacgttgaaaacctcaccagactctcataatttttgcttttaaaagtcatacatattataaagaggttaagaggaaaaaagtagtctattatttactatttctattcattcttcttgcattctagtggttccatctttcctctggtaacactttgtctacagaacttcctttaccactattttatagcaggtctgctggtaatggattcacttggttgtgtttcatatgagaatgtctttatttcgtctttatttctgaaggacaccttcactggatatagaattctaaatacagaaatcagttctttcactgctttaaaaatattgttccactgccttatggcatccgtagtttctcatgagataccagtaatcatatgaattatcattccccaattgtggcatgtgtttttctttggctgtttttgtgggattttttttgtctttggattttatctgtttaagacgtatctagacctggtttttgctgtttttcctgttttggattggttgaacttcttgaatctacaagtttgactcttgaaaaatttgagaagttttcaactattgtttcttcaatttttttttttttttgtagtattctttttcctctttctctgacaggcagtgactcaaacactagagcttttgttaatcttctgcagttctggaggtcctctgttttttccccaaagctttttcctcttggttgtttatagtgttctgttgatctgtcttcaagttcacagtctcttttcctttggttatccccattctcccatacagttcatccagtaaattttttgttctggatattttatttttcagcaataaattttccttttgtttctttatatcttacatttctttgctgagacttcttctgtttttccatgtttcaagattgtttgctctacttttttgaaacctttgtaatagttgttgtagatttttcatctaatcgtcccaaatctgagctgtatcagggttggtgtctttttattgtcttttgtcttgcgagttgttgagattttcctggttctttgtatgacaagtaattttgaatgatatcctagatattttcatcattactttattgactctgggtcctgtttataacctatattgagcattaattttttttttcaattttagcagccatttgatacagttaggttcattttccagcttctgcgtgactcccttcctaatcttctggctgggggcttaggtctgcctattctgctcttctccagggccaagtgtggggaggataaagagaaaaaagtaacagaaatttcagaccctctcactctagactacagttcatctggtcataaacaaggatttccatcagagttttggcatctcctcagctgctactgccatcattgctgctcccataagattgtgtcttagggatttggacttgcttggggtctggggcaggagagaaaataaatatacaaaagaaaccagggagttttcttctactgttttagtttcatctcccatcacccctccccgcttttgttccttgggccagaaaggacctctcttggagctccttctgtctgcactcagtttgtactttgggaattggagaattgggtaggagctgagcatgggctggaaaagagggcaggagtagacctatcactggataggtcataccttgaattgtagtttatttccatttacttttcagagtcttgatttgtgcattctgttcagatttttaggtgaattcagtgggagacgggagaagttagcttactgcatctgaaccagaaaacttccttaaaatatttttgagtgtttaatattgtatctcatttattttccaaattttgattaattaatatattatttacttaaagaatcatgaaaggatttaaaagaattataaaatccaggatttgaaattaccttagaagtcatttaggccatttacttttgacaaattctcttcacctcaaacaatagctaataatagctaagattgactacgtacctgccagtgtattaagctcatggtctacattaattcatttaattctcacaaaaatcctatcaagtttttagctccattttactgatgagaaaactaaagtttagaaagccttctcaagatgcggtccttggaccagtcatattgccattactttgagagcctatgaggaatgcagaatcttgggtttcaacacagatccttagaaccataatctacatttggacaagatccccaaggtgattcatttgcacattaactttttcaatgcactggtttaaataaattataaataacttgatgaaggtcacctagcgtgcaagttacctttaggatcaagagagtaagcagtttacctttagctggagaatgctctaacatagccagttgctagaattaaactgtaccttatgcagtttgaattttctttgtttcttgaagaagttagggcacaaataagctatttattctgttatctgtacttttcaaatactatttatgcagagtcaagtatccttagggaatgcctgtctacattgaaaaggacttagaggctaattatcctatcatctggtatatcaagagagatgaagaggaaacatggcagtctttgaaataacattaagctaatcgaaatttagcacttattcagattgctacccttaaataccttccccacaaagaagccagagtgtcattttaaagaataaatcagatcatgttacagctttgtgtaaaatgctccaccagcttcctgttgctcttaaattcagacaccttgccatagttcagatgactacttctttttttagctttatcttaaaccagagctccagctctttccatatacttcaaccatattgacctttcatctctttcttgagcatgacaagctctttcgcattcacatttgcactacctcctcctttcatttggattgatctccatgaagcttttcttacatcggctcgcagttcaaatgttacctcctcagagaagccttccctaatttaccatgttggaaataccctttcacaaacacgtacctggtcatactgcataatttgacattcttatgtagtatttatagcatttttcagtaccagaaagtattttatttacgtaatttgttacttctctcgcgtaccaccctcaggagaacgtaaaggtccaggagggtcagtatctcatcggtttgctgtaatatacccaaagcctaggtttttgtgaacatcaaattagtgtattcatgtaagactctgagaatgggtctggcatattgtacacacttgtcagctgctgctattgttgttagtacaagtgatgatagtgataatatatttaggcatttgtgaaactcaatggaataatttattttgaataaattcaaggtaatatctaattattagaactgagtactgtagttaagcatttctatttttataggattgaaaaagtgaaaacagtctaaataatagttctttgattggaagtgttttccccatgtttttctcttaggcagttgtgatcagaccatcaggatatagagatgaggatcctcagaaacacatccatctcctaaaattatgaaccagctggggcatggagtttttgaagtcacttttgaacttttcagctaaaagccagttttgctggaaatgattgctcctagatattagattcaaactgcttttctccctaatctagacttatgcaaaatcaggcatcatagtatgttcagagtgatattcagtgttgtatgcttcactgtatggcatttttattggtgcagtcattgaaataaatgtatgtttatatagcattctgtatatcatgagttactctgccttttgtctctgggtccataggtaacagttaacctcttccacatgcagcatctgcaggctgcttcccttgcagacagtttacagtctctctgtgatagtgccaaactctatgacccaggccaagagtacagtgaatttgtcaaggccacaaattcaactgaagaagaaaaagttgatggaaatgtaaataaacatttaaatagttcccaaccttcaggatttggacctgccaactctttagaggatgttgtacgccttcctgacagttctaataaaattgaagaggacagatgctctaacagtgcagatataacaggtccttcctttataagatcatggacatttgggatgtttagtgattctgagagcactggagggagcagcgaatctagatctctggattcagaatctataagtccaggagactttcatcgaaaacttccacgaacaccatccagtggaactatgtcctctgcagatgatctagatgaaagagagccaccttccccttcagaaactggacccaattcccttggaacatttaagaaaacattgatgtcaaaggcagctctcacacacaagtttcgcaaattgagatcccccacgaaatgtagggattgtgaaggcattgtagtgttccaaggtgttgaatgtgaagagtgtctccttgtttgtcatcgaaagtgtttggaaaatttagtcattatttgtggtcatcagaaacttccaggaaaaatacacttatttggagcagaattcacacaagttgcaaaaaaggaaccagatggtatcccttttatactcaaaatatgtgcctcagagattgaaaatagagctttgtgtctacagggaatttatcgtgtgtgtggaaacaaaataaaaactgaaaaattgtgtcaagctttggaaaatggaatgcacttggtagatatttcagaatttagttcacatgatatctgtgacgtcttgaaattataccttcggcagctcccagaaccatttattttatttcgattgtacaaggaatttatagaccttgcaaaagagatccaacatgtaaatgaagaacaagagacaaaaaagaatagtcttgaagacaaaaaatggccaaatatgtgtatagaaataaaccgaattcttctaaaaagcaaagaccttctaagacaattgccagcatcaaattttaacagtcttcatttccttatagtacatctaaagcgggtagtagatcatgcagaagaaaacaagatgaactccaaaaacttgggggtgatatttggaccaagtctcattaggccaaggcccacaactgctcctatcaccatctcctcccttgcagagtattcaaatcaagcacgcttggtagagtttctcattacttactcacagaagatcttcgatgggtccctacaaccacaagatgttatgtgtagcataggtgttgttgatcaaggctgttttccaaagcctctgttatcaccagaagaaagagacattgaacgttccatgaagtcactatttttttcttcaaaggaagatatccatacttcagagagtgaaagcaaaatttttgaacgagctacatcatttgaggaatcagaacgcaagcaaaatgcgttaggaaaatgtgatgcatgtctcagtggtgagtagccatgtaaaaaaaaaatatgtttgctggcttaaaattttaccagtagaaccgtgattaaaaccaaggtgaggggcaatgagggaagccagagaatgaagctttattagttaacaaatcttggctagccattgagaaagttgccttttagtgtatcttgcatttaaatgaatgtcattcttcataaaagtctttcttataataagacatcttggagtttataatgttttttgtgttccttctgaattttgtttttgtttttgagttttgccatcagctaaaatcaaggtagaaatgtgttgagcaatgtgatattcgttagtatcttccagttccgtagttcagtgcattgagctaactgctcatacagagtcaactagactcctgaaattcaaaaactttagagtcctactttttttttgacatgctttttacctgtggcctacatttaacctattaaacacagagatgtgtatgtcttttttctttccttgactgcgatcattttattcacttattttctctttataatattagttgctgtcattgctagttgttaagctggtggaaaagcttccatttgtattgtcatttctacattgttatagctaaattccagttttttacattgcagccatatatgttaaatttaatgtgtaatcaagtatcagtgatcatagggtctaaaaaggaaaggagggccgggcatggtggctcacgcctgtaatcccagcactttgagaggccaaggcgggcagatcacctgaggtcaggagtttgagaccagcttggccaacatggtgaaaccccgcctactaaaagtacaaaaaattagccaggtgtggtggtgggcgcctgtaatcccagctactcgggaggctaaggcaggagaatcacttgaacccgagaagcagaggttgcagtgaggcgagaacgtgccattgcactccagccagggtgacaagagaaactccatctcaaagaaaaaaaaaa

SEQ ID NO: 1435 - DNA, 2043 bp, Homo sapiens
  ENST00000370217
gggcgggcggtgcggccgtggcggtagctgcaggggcggtggcggctgcagtggtggtggtgcctgtggctgtggctgcggctgcggctgcggctgagatttggccgggcgtccgcaggccgtgggggatgggggcagcgagctccagccctcggcggtggcggcggccgtaggtgtggggcgggcgtccgcgtccggcacgcgagatggagcgccgtggatttcagtttttctgactgttacatgaaaggatgattgctcacaaacagaaaaagacaaagaaaaaacgtgcttgggcatcaggtcaactctctactgatattacaacttctgaaatggggctcaagtccttaagttccaactctatttttgatccggattacatcaaggagttggtgaatgatatcaggaagttctcccacatgttactatatttgaaagaagccatattttcagactgttttaaagaagttattcatatacgtctagaggaactgctccgtgttttaaagtctataatgaataaacatcagaacctcaattctgttgatcttcaaaatgctgcagaaatgctcactgcaaaagtgaaagctgtgaacttcacagaagttaatgaagaaaacaaaaacgatctcttccaggaagtgttttcttctattgaaactttggcatttacctttggaaatatccttacaaacttccttatgggagatgtaggcaatgattcattattgcgactgcctgtttctcgagaaactaagtcgtttgaaaatgtttctgtggaatcagtggactcatccagtgaaaaaggaaatttttcccctttagaactagacaacgtgctgttaaagaacactgactctatcgagctggctttgtcatatgctaaaacttggtcaaaatatactaagaacatagtttcatgggttgaaaaaaagcttaacttggaattggagtccactagaaatatggtcaagttggcagaggcaactagaactaacattggaattcaggagttcatgccactgcagtctctgtttactaatgctcttcttaatgatatagaaagcagtcaccttttacaacaaacaattgcagctctccaggctaacaaatttgtgcagcctctacttggaaggaaaaatgaaatggaaaaacaaaggaaagaaataaaagagctttggaaacaggagcaaaataaaatgcttgaagcagagaatgctctcaaaaaggcaaaattattatgcatgcaacgtcaagatgaatatgagaaagcaaagtcttccatgtttcgtgcagaagaggagcatctgtcttcaagtggcggattagcaaaaaatctcaacaagcaactagaaaaaaagcgaaggttggaagaggaggctctccaaaaagtaacgatctttttcttttttatttgcaagttgaattagcggtaatctgccaggagtttggtgtcaaagttctgcgtctgccaagactgcctggaaaggcatgttaaaacatggctaagcccatcccccagagtttctcattcagtaggtcaacattttttaataggctctcaggtcgtgctgatgctgttggtgaagatccacattttgagaaccactatgctgagacctgaattttggagtttgtgaaagaatgtcttagagaaggcagtagtttattttacttgacaagaaagttcaccttttaggcaagtgtgtgtgtgtatgtgtactaattcaggcacctgatagcaaggataggcaaaagctttgtattattgatgaaatgtaattttacgaacaaattctgtaagattatatggaatatagtaaatataaatataaaatgctatttcaaatagaagcaaatattttatagacagtgtactaattataaattgtacatggctgtccattaaaatcaactgcctttgaatcactgaccagaacagattaacttcagaagtattattttgaaaacagaagatttcagaattttcagttatttcaacttagctttactatagtaaatatttgtttaaaatataaa

SEQ ID NO: 1436 - DNA, 10111 bp, Homo sapiens
  ENST00000310343
atggagactgaaagtgagagtagcactttaggggatgacagtgtcttctggttggagtctgaagttataatccaggtgactgactgtgaagaggaagaaagggaagagaagttcaggaagatgaagtcctcagtacattctgaagaagatgattttgttccagagctacatagaaatgtacaccctcgagagcggcctgattgggaagaaactcttagcgcaatggcaagaggcgcagatgttccagagattcctggagatcttactcttaagacgtgtggcagtacagccagtatgaaggttaagcatgtgaaaaagttacccttcactaaaggtcactttccgaagatggctgaatgtgcgcatttccattatgagaatgttgagttcggcagcatacagctttcactttcagaagaacagaatgaagtaatgaaaaatggctgtgaatctaaagagctggtctacctcgtgcagattgcttgtcagggaaaaagttggattgttaaaagaagttatgaagattttcgggtacttgataaacatcttcatctgtgtatttatgaccgaagattttcccagctctcagaacttccccgttctgacaccctgaaggacagtccagagtcggtcactcagatgcttatggcttacctgtcacgcctttcagctatcgctggcaacaagatcaactgtgggcccgcccttacctggatggagattgataataagggaaatcaccttttggttcatgaggagtcatccatcaacactcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcattaaaaaaaaaaaaaaaaaaaaaagcccagcatggtttgactggatagacacgcataatttattatgaatataaatttccatgtttgtttctgttcctaaaccagagtacgaggtccctgggaatttaagtagctacgcattatctattattagactgcaagttcctgcaataactgcttagttcacagccccgtttcaccagtggagttctgggcagttattgctgtcctaaggcattactgtcgtttgcttactctatacttgtgtggtcacagtcttcttgtaattaccatctacaccagcatttcaggtatagctctttataactctggagacatgtaaaacatgtttaacacccacgagttttgaaagttgcattccttattagagtaggaactctctagcccaactccattctatgttctcagctccctccaccccccaaaatacatcagactagcaaggcagtcctatgtttacaaaacgagtttagattgtcatttcattccataactcttaataatactcaagttttatacattcacgtattttaaatgctcggtctgtagaagacactaggagaattgcattccaattactggatggttgctgctctggctttttagaacttgaaattaatttttatttagagcaaaggaggaaatcttttaagaggctaaaatcatgctgctattattgctgtgaaattgtataaagattaggattcatgccagtttttattttaaaaaataatgtgcattttaagggtttatatttagaaaaaaataaaatgtttcaagaacaacacattgatatgtggaaatattctataaggttttcttttgttcccttagaattcattggagggatgcagtaaaaactgtagtagaaaccttgaaacacccatatgtgaaaaggtctgtggaaattgaggcctctacattaaaagtgcagaaccaactgttttacagtcaaagtgctaggaaacctgataggatacttccctttggcacaaaaacaccctgggtgctacatacaggagtatgacctttggtgaatatgtggcactaattttttttaccttaatcatattcttgtcaagtaggcaacccattgccccttggagaccacaccagccctgtaagttctcaccagcagcatggagattaggaagaggggctgctgtgaccaggagatacacacggctttaagtaactgagagcctaaagaaagtaacccagggagtccggtccagttttaatatttgtggatttgttgtcacacacattgtttagtcctgaaactaaaacctattttataaatagtagggttaattcctcgaaacaatttctttattaataaatgtcctgtgggtttagaaatatcaggtaaatatttgaatacagaatgatgattgcaattactgttacaagcgtgaaacacaaacttcagatcaaatctagagttgcttcatttaatgcatgctagcaacagccttaactttggattcagttatttgaaacacttttccggcatctttccctttctaatgttgtggggtggaaaccggatggcaaatcactgtgagccggatacctcagcacagtccaccttgtgtgtgacttcacaaatgggggacttcacaaatggggtaactgaatgttattactttcaaattttgacatggagcattatgatcaaggaaatggagctgccttatacattaaacccgtgatttaatcctattgacattttcatagccatgcctccagattttatctttttggcaaaattctgattccacagtttggtctgattgaaataaatattccctggacgtctggctaaaaattttgctaacaatcccagaggtgccattttcttattaataaatttcattggagccttatttcttactatattcaatttcgtttcaaacctgcaagtccctgggatggtcccacgactagggcctgcacatttcttacaatggcaaagcattttttaaaatttagggtcaggttgaaaaattctaggactaattctgtagagaggagggactgttaactaacgtgagtggggacggaggagtaggttaccacatttggagcagtaatagatgcaaacgatgtaaatttgaaatttgcccctttagttaaagaaggagcctgcaaagtccatttctctgttttcagccctgtcagtcacccatttaggatgttggcaaagtactgcttgagcagaatgtgtaagaaagtaataatgaaagcaaaagtatgtcagacagttacttcttccacatggttagaggcatgtgattttcagcactgtgtgttacagaaatgtcaggaatggtgtattataacgtgtgcaagataatgtcagtgtgcacagagggtcttttttccttatctgattagtactgttaatgttcaaagaataaaaatggttttacagtttagattctgagatagcaaaacctgatttttcaaccatgacctgcatgagagaagcatcctaggaagtcttagatcatacttttgagtttttaattttaatttatatagtgtttttttatgtcttaatatttttgtgaactggtgtaaattgttaatgcatataagcttgtgtatttttgtaaatagttttgtgatttatttcttgccccatatgtaaatatttagagtctcatttcttgcaaacttatttgaagctgagttgtgggtttgggttttgtttgtttctttggttgcagggtggggtggggggtggcaggggagggaggaagggatttttgtacctggagatggagatatcttgtggtttaaagcaaatgtcccactgaaagtgattcaaatatcaacagaattatttcaggttaaaacaga

SEQ ID NO: 1437 - DNA, 6868 bp, Homo sapiens
  ENST00000526162
agaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggtaccgtttgttttcctccattctttctttaagttaagagggatcttcaatcctgtgtgccatctgtgccttttaagagagaaatttgtccacagctagcctttaatcaaagagaatgcttttctgggtggtgctgatggctcagagccctaaattaaaagcagtccaacaaaactccccaaaagggccaatggtcctgcttcaaatcttcacaaaagtccccttatctctttggacggtgagaattcgtggataatttttgcacaactgcgtagctcttgattctgtttttctcttctaataaaatatctttattgtagccttccaagttaacaagccagctacaccatcaaatgtaaaaactgttcataataacagtctacaagcacttgaagcttgttttctaagcaatcttttctgagccaggtgagggacatgctttttttcccccccatctctgtaacaattcaagaagagattgcagtctttatacactgtttgttttagttttccttctgaaccagatgtgttttcaacagcatttgcatgtgggatagaagatcatggattgccattttgaaatatggaaggcacctattttttaatgatcacatggggagtgtttggctttccatttaggataacgtaagctaccttttcactctcattttttttcccaatttcccactaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcattaaaaaaaaaaaaaaaaaaaaaa

SEQ ID NO: 1438 - DNA, 6556 bp, Homo sapiens
  ENST00000392657
aaagcagtatgtgctgagagaggaggattaagctcctggaggcagagctctcccacacacttgctggcttgctgggctccactgactggactgaaaacagggccaagaaaactgctgctgcagggggtcctgaaaacagctggaacccggcagtgatgtgggacctaacttgaagttaacctgtggtggtgaggttggaaccagttggattatgatttattttctacactcttgtacggaatgcagagctgttgtatcctgatgaatctactgctaaatatagtcatttggaataattttaagtattgatcttaaaacttgtaccacaacaagagtgtctaaaaagcacggcaagctcattacgttcttacgaacattcatgaagtctcgtccaacaaaacagaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcatt

SEQ ID NO: 1439 - DNA, 8194 bp, Homo sapiens
  ENST00000524655
gattgggaagaaactcttagcgcaatggcaagaggcgcagatgttccagagattcctggagatcttactcttaagacgtgtggcagtacagccagtatgaaggttaagcatgtgaaaaagttacccttcactaaaggtcactttccgaagatggctgaatgtgcgcatttccattatgagaatgttgagttcggcagcatacagctttcactttcagaagaacagaatgaagtaatgaaaaatggctgtgaatctaaagagctggtctacctcgtgcagattgcttgtcagggaaaaagttggattgttaaaagaagttatgaagattttcgggtacttgataaacatcttcatctgtgtatttatgaccgaagattttcccagctctcagaacttccccgttctgacaccctgaaggacagtccagagtcggtcactcagatgcttatggcttacctgtcacgcctttcagctatcgctggcaacaagatcaactgtgggcccgcccttacctggatggagattgataataagggaaatcaccttttggttcatgaggagtcatccatcaacactcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggtaccgtttgttttcctccattctttctttaagttaagagggatcttcaatcctgtgtgccatctgtgccttttaagagagaaatttgtccacagctagcctttaatcaaagagaatgcttttctgggtggtgctgatggctcagagccctaaattaaaagcagtccaacaaaactccccaaaagggccaatggtcctgcttcaaatcttcacaaaagtccccttatctctttggacggtgagaattcgtggataatttttgcacaactgcgtagctcttgattctgtttttctcttctaataaaatatctttattgtagccttccaagttaacaagccagctacaccatcaaatgtaaaaactgttcataataacagtctacaagcacttgaagcttgttttctaagcaatcttttctgagccaggtgagggacatgctttttttcccccccatctctgtaacaattcaagaagagattgcagtctttatacactgtttgttttagttttccttctgaaccagatgtgttttcaacagcatttgcatgtgggatagaagatcatggattgccattttgaaatatggaaggcacctattttttaatgatcacatggggagtgtttggctttccatttaggataacgtaagctaccttttcactctcattttttttcccaatttcccactaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggtaagaaggggaagatatcagtgagatgaaatatactattaccaaaggtatgtcacttttcagcagggtgtgttgttatctttgagtcagacacaacaattacttttaagccctgtggctggtttccatgagatagttcccatttgaggttggagtctgccattaccttgatgctggcttttccccaggaaaggagtagctcctagatgactatagcttaactgtacctgctcccttttcttcctaaagtgtctcggtagtttattccagtaacacaaagagatcaggatcaaatgagacaaagtgggctttacggttgtgggttgctttttcttatttttttccaactccatcactgactcattgtgactttgggcaagtcatttacctaccctctgccaattattcacagttacacaatgaaaatacttcattctcaaaacattcgtaagactgtctgccttgcagactttttggaagtataagagattatagtgccttgggattttttgttactttcctagcattcaccagcagtttgtcccatagtcaggtgcctgtttcaatgagagaatgtagtatgcagaatgctaaggtttcttcctgaatttcctcatattttaagaaagtgccacaggttgtttttcttctatatggtcaccttgaactattaataggacttaagattttagaccttagtggaggatgctgtgtttactgcttctcaaggatagcatgttttcagtatgaggattatctttggccagactaaggtggaatcaaaggtaggagagaggcagtagcttctgatttgaatattgcctttccctatgtttgaagccctaaaactgctaactgtgtacaactgtgaatttcaaaagtctccccagatgatagaattaactcttaatttaacaagatgtcctttgtgttgagactgagctagactaatagaccgggtatgtatttttaagctctacagcattacttgactaaacctctcttttggtttgtatattaaaattatgccataggcaacctcatctcgcatttaaaacctctcataaattagaaaactttgaatggttctccaaagataatactgggtgttgtacaaaatagcagcacaagccttcttttcctagaaatgggtacagattcattgcaaccacatggcttgggaaagttcaagctgctacccaaccagccttaatttgtgagttacaaatttaatagtacttgattcatagagggaacaaaaaatagacccatagtattatcatctttcaataggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagca

SEQ ID NO: 1440 - DNA, 5289 bp, Homo sapiens
  ENST00000527272
gcacggcaagctcattacgttcttacgaacattcatgaagtctcgtccaacaaaacagaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctgga

SEQ ID NO: 1441 - DNA, 401 bp, Homo sapiens
  ENST00000534357
cagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaaggtaaaatttgttaaatcctattttgggatatgattttcatagctatgtcctattattttcttttag

SEQ ID NO: 1442 - DNA, 1064 bp, Homo sapiens
  ENST00000533509
atcttcatctgtgtatttatgaccgaagattttcccagctctcagaacttccccgttctgacaccctgaaggacagtccagagtcggtcactcagatgcttatggcttacctgtcacgcctttcagctatcgctggcaacaagatcaactgtgggcccgcccttacctggatggagattgataataagggaaatcaccttttggttcatgaggagtcatccatcaacactcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacaggtcagccacagtgggtaaataccaggcagaggtagaagtcggttgacctgtaaacgtttttttttcctttggatttctatttaaacttccttggagttctaattaaacttccatttcatatata

SEQ ID NO: 1443 - DNA, 719 bp, Homo sapiens
  ENST00000525234
gcccggccgagcccccgcggctgccctcggcggccaggcgctaggctcggcggcgcgggcggcgctcggcggcggcggcggcgggcggagggcgtcgggcccggcccgcggagggcagacacggagcggccagcggggcgcagggacgccgcggcggcgcggcggggccgcggggctcggaagatgaagtcctcagtacattctgaagaagatgattttgttccagagctacatagaaatgtacaccctcgagagcggcctgattgggaagaaactcttagcgcaatggcaagaggcgcagatgttccagagattcctggagatcttactcttaagacgtgtggcagtacagccagtatgaaggttaagcatgtgaaaaagtccaccactccaggactgatgggctgtgacaacattcacaggttacccttcactaaaggtcactttccgaagatggctgaatgtgcgcatttccattatgagaatgttgagttcggcagcatacagctttcactttcagaagaacagaatgaagtaatgaaaaatggctgtgaatctaaagagctggtctacctcgtgcagattgcttgtcagggaaaaagttggattgttaaaagaagttatgaagattttcgggtacttgataaacatcttcatctgtgtatttatgaccgaagattttcccagctctcagaacttccccgttctgacaccctgaa

SEQ ID NO: 1444 - DNA, 4488 bp, Homo sapiens
  ENST00000361221
gcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagctttctccagacctgactaggctaaaggagagatacgccaggactaagagagacatcttggctttgagagttggggggagagacatgcaggagctgaagcacaagtacgattgtaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagcctgccaaccacaggggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgga

SEQ ID NO: 1445 - DNA, 4035 bp, Homo sapiens
  ENST00000375415
gtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagcctgccaaccacaggggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctg

SEQ ID NO: 1446 - DNA, 539 bp, Homo sapiens
  ENST00000482892
tctccggggcccggcactccagctggaagcggaagagttcccgtcgcattgaccggttcactttccccgccctggaagaggatgtgatttatgacgacgtcccctgcgagagcccagatgcgcatcagcccggggctctccgtccaatggggaagcacagcccctgcttttgaggagctccgagtctgatggggcagctctaaccatccttgagcagcacagagcgcaatgggagagacacacagacaacacggcaaggcccgagggccccagagccacactcctgactcctgtctcaggaacggggacacctgggccaaggatatgcttatccctttagcaagcctgggatgtgcttggagcacattttcctgtttgtagctcacttgagtccagggagcaatggattcccactgtattaggaggcaaaggagtctcagaaaagtcccagagctgggaggtctgagcggctgaggggcctcagttgttgtttaacccatttggcctatttcccacctgaattcaatcaagtcactaag

SEQ ID NO: 1447 - DNA, 4585 bp, Homo sapiens
  ENST00000469726
attagaaatttgggtgcttcctcgcaccagcacatttcaagtgctcaatagtcgcatgtggcccgtggctcccattttggacagggcagatacagagtgtttctgtcattgcagagccttctctttgctggtgctgctgtatgctggagaagatgcgggtgctagggctggggcttgggaggacaaaggactggctgaggggacagcagctctgtcaggcctgggttcccccagcacctcggatgcccacttccctcttctgggcacgcggtctccttacgtctcatgttctgcttagcttgctacgctcgtgtccatggatcccctccccactgccagaggaagctgcctcttctttctggcaacttcagccttttctccttttcccggatggtggctcagtaagaaacctggctgtttcgggggaggcaagggacgggtccctcacctgggtttggcggatgggatgggggtgtgcacacacctcctttagttgctcctaaggtcatgttcaacattcgtggagtgcatttttctgctcagggagctttcccagacccggaatgtttggtgctcacagaccctggcaaggatcggtattgctgttcctcagttttgcctggggaaatggaggctcagtgacgttcagtgacgtgcccagagtcatgccattggcgggtggcccagggctccaggtctccagcacccctcggccccctcctcaccaggtcacatcatctcctggattagaaatctgctcacatagtctgtcctgaaaggaaaaaaatcggttacagcctcctgttgcccctaaagagggagatccccgggcatgaacgcaccttctcacccccactgtcgtccttggcctttgctcacggacctgggagggaagggtctgggtggttctgatctctgcaggccgaggcctggggaggcgggtggccctcggtagcaggcatcccaggccgtcccttccctgatgagcctctctacctttgctcagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagtt

SEQ ID NO: 1448 - DNA, 3685 bp, Homo sapiens
  ENST00000375408
attaatagccgtggcagggctcgaatcacaggccaagaatgttacccagcagctcgtgggggaagaggaagctgcgaggcaggctggggtgggtgcggagtgatgcccggggcgtgatgtgggcccggcaggagggtctgcaccacccccacccccacgccgtcatccgctgtccctcctcctcctcctcctctgtctcctgctcaggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgg

SEQ ID NO: 1449 - DNA, 3018 bp, Homo sapiens
  ENST00000167825
aagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccagacaggtcattaataaaatgttctccaagagcctgagctttttaaagttgtatatctccagatagatggcttgggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgg

SEQ ID NO: 1450 - DNA, 604 bp, Homo sapiens
  ENST00000482359
ggggaatcagtttgggtgatttgggctgagtcacttcacttgactgaggatcagtgtccttgtctgggatcatctaagcttcctagcggggctgttgtgagacccagagatgaaggaaggcccgcttctgtccacacctggcctctgatgccctcattccccgcaggaggctgtctctccttctattcccgatgcccagccccatggctggcccccagcggggtcacagcccccagattagccactccattgtaataacaatctccctttccttcttgtcttttttcccaggcctgccaaccacaggggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccag

SEQ ID NO: 1451 - DNA, 482 bp, Homo sapiens
  ENST00000466782
ctcagcaaacatttactgagcaactgtcccatgccaggtgctgggaacagacccaagtgagacccattcctccctctagaggcacgtggtcagacatgtaaggtgtctaagacctgtggacagctgaccgctgaccaggtggagtcacagcctgcagaggctctgccgggcacaaagccagaggctcctggagccaggctggggagcgtggctcagccaccctggccaggtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaac

SEQ ID NO: 1452 - DNA, 2261 bp, Homo sapiens
  ENST00000495593
attgctagaattgttggcaacagtgcagcagcagcgatgacagcaggtagcgcccattttgccatgtgcaggcacggggttgttttacgttcattcatttaacccaatggagagtatctgtgttccaaacatcaaaaagggacagtaaaaatacggtcctataggactgccattgtatacatggtctgttgttgactgaaaggtcattatgtgacatgtgactgtattatccttggccccttttacaagtgaggacaccatggcccagaggagtttaggatgggccccaggtcatgtagctggagagtggcagagccaaggtgtgaatcccgcacctggctctggagccctgttctcagccaccgtgctgggcagcccacacctggcatcctctctgttaggagcaggggcctgcccccacgccctctctgacattgctattcttgctaaaatgaagagacagagctgaggggagagctaaaaagaatgaatctggactggcatcagaaacatgctgcttcccaccagcgagttttgtgcttcactcttgggcccagggcctgcagggtgtgctgtgacctcatctgaagaagcacccacacgggcaggccctgaggggctgcagcagagccacctcgatgcctctcgagccccacccggccctacttatgccttccatctgcaccaacaccgatgagaagcttgcacctccccagtcttccctggttttgctcgtagctggctggctggatccctgcatggattgcccttggacaaccctttgtgccggatgacctggccgccgtgtattgagagcgcacacagaccaggcgctgtgcctgtggtgttcccccaatgcatccgtatggcagccccactttacacaggcggaaactgaggctggttaggggagtgctcagctgcaggacctcgtggccagaccccaggcaggtcagcctccaaagccccagctcttccccaccccaccgcccaacttcttgctggtttcaggggaggagcccgctgtgccaggccctcatctcgtggtggtacccagagcccatgctgtctccccaggagggcactgctcagccgccctctctttctgcaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctggacttgg

SEQ ID NO: 1453 - DNA, 4080 bp, Homo sapiens
  ENST00000313695
gggatcccgggagggagcggagcggacctgggcttggtcgcctccaagccggcgggaccgagtgctttaggccgcttgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactccataa

SEQ ID NO: 1454 - DNA, 4149 bp, Homo sapiens
  ENST00000361247
gagaccaacgcgtgcgggccgaacccctccccccgccttcccccaacaatacaggacgccggggtccgcgccgcgtcctccctggtccccccgtccgattatgtctcggatcgaatccctcacgcgggcgcggatcgaccggagcagagagctggcgagcaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 1455 - DNA, 4438 bp, Homo sapiens
  ENST00000462460
acattgtaggggctgctggccatggaagggcactgtctctctgctttgacaatggtccccttgaacaagttcctttagctctggaggagactgcaagcatcgggatgcccaggccccaaggaggccctcttcctgcagatccgagaaggactggacacctttctgggactgcagcaccagggtggctacgcctcccggctggatcaggattcctgtcatccatctgctggccctttggaccactcggccactggcatgctttccaagtctgtacccgtgagtggcatcaactgtctcttggaccgttcggatacagatgggaatgtatcccagtcctctgccattgacctcaggaaacgctgcagccagctggaaggacattcaggtacccgggtaggctcctccctgcgacagaccttcagcttcctctcgggcatgaccggaaaggccaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcc

SEQ ID NO: 1456 - DNA, 883 bp, Homo sapiens
  ENST00000477754
cccccaccaaagtgctggactgggttcttaaaggggccacctgaagcaggactttttcccacactgaagtcaccaactgacagcagaaacaggtcccccatctttgggatatctcccagttctgctcccagtagaatgtctaagaaatctttgatgaccagtgcaatctgtggaggttatacacttggaggaagggacagcacacgctgatggtttgcagtggtgggaagaccatctgatccagaggcaggaagataagtaaaatgacttcttagagccccttcctgctttcccagctcccctcccccatctcaagcatctgatcccagacctatttcagaatctcctatctctttgctcagtggaagcagtgatatgacatgatgtgatctcatttgagggctaaataaagccattgtgtgagacccagccctggcctctcccctgcaccatttcctgagctcaagaggctaagggaaaatgggaggggggctaggagagttaatctaatggaaaaagaagcaacacgatgatgggacccccagtttgaatttcagacagtggaggagggaatattgctaggagggagttgaggaagccttgttaaacctcatctctttgagggacagaataaaaagtattggcatcatagcatagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcc

SEQ ID NO: 1457 - DNA, 1877 bp, Homo sapiens
  ENST00000470541
cgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgaggtgagaccctggcggagacatggaccagagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactc

SEQ ID NO: 1458 - DNA, 2958 bp, Homo sapiens
  ENST00000313667
atgtctcggatcgaatccctcacgcgggcgcggatcgaccggagcagagagctggcgagcaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaa

SEQ ID NO: 1459 - DNA, 742 bp, Homo sapiens
  ENST00000474428
ccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcactggagttgcagcagaaggaccgggcactggtggagctgctgcgagagaaggtcgggctgtttgctgagatgacccatttccaggccgaagaggatgg

SEQ ID NO: 1460 - DNA, 638 bp, Homo sapiens
  ENST00000470975
gtgagtgaaactggttgagccgttccccatgccaacccccggtgccagggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggca

SEQ ID NO: 1461 - DNA, 820 bp, Homo sapiens
  ENST00000608543
ctttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccgggtgagcggacctctccagatcccatgctcatggcccaaacccaccctccccaactcatgggggtagtgcctgtgagctgcacccacatggaggtcaggcattcgccacccgtgcagaccatccatacacagatcctgtcagcagtaacccctcagaatgctagagcacgttgtggtagtttcccaagtactttttgctccttcagttggtcctcacaacaaacctgtggcgttgttatccccattttccagatatgtcacctaggcaagcatgaggtaaatggccacgccagggccagcaccagagctcaggccccaggcctttctgttgccctcccctctggccctgagccctgcctcctcccttgtagaaagtgacccgccccgccgtgctcaagcggcacggggtacaggagtgcatcctgctggtgactcagcgcatcaccaagtacccgttactcatcagccgcatcctgcagcattcccacggtgagtaggcaggcccaggagagggccactgggagacggccacctggggtgaggaaaggctcggtatgaccacaggaagggtggggtcgggtgtgaaaccctgggcagcctctaaaggtggaatcaagacacgatgggaactggggtgtgagtgaaactggttgag

SEQ ID NO: 1462 - DNA, 372 bp, Homo sapiens
  ENST00000470874
caacagaaagcggccctgctgaagaacaacaccgccttgcagtccgtttctcttcgaagtaagaacatttcaatgatgagtctcccctggggctgcgccggatcctctcacagtccacagactccctcaacatgcggaaccgaaccctatccgtggaatccctcattgacgaagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctct

SEQ ID NO: 1463 - DNA, 892 bp, Homo sapiens
  ENST00000471589
gatccagcgtttagttctcctttgatttcctctccctctggccacccctgcccccaatcgtaaaaggggtcagtctgctcaggcctgctttgatgggaccccgaaggccaggaaggaactggtcctgggttttctaagagctgggggcggatggaattctcctgcctgcgggtctttaaagactgagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatc

SEQ ID NO: 1464 - DNA, 764 bp, Homo sapiens
  ENST00000497907
gacggtgctgggatcccgggagggagcggagcggacctgggcttggtcgcctccaagccggcgggaccgagtgctttaggccgcttgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatg

SEQ ID NO: 1465 - DNA, 668 bp, Homo sapiens
  ENST00000476273
ctccccccgccttcccccaacaatacaggacgccggggtccgcgccgcgtcctccctggtccccccgtccgattatgtctcggatcgaatccctcacgcgggcgcggatcgaccggagcagagagctggcgagcaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagaacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatg

SEQ ID NO: 1466 - DNA, 692 bp, Homo sapiens
  ENST00000609707
aaagcgctggtgagctggcaccctccgcttcgcctgctctcccctcctctctgcgcatcttccccctagcacagagaagagagtacagcagctcgggggtgagcagagctagggctgggaaggtggagtgaggacgcagagacctagagccagggagatgagtggcaacaggaggcagcccagccgtaggggccagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccg

SEQ ID NO: 1467 - DNA, 2176 bp, Homo sapiens
  ENST00000487755
aggagaacagtggcggagaagcaaggctgagaaagggaaggcagagcgggaggagcctaggagggagaccctgagaagagaagggaggacatagagagagcaggagacaggaggaggatgcgaaaaatggatgattggggatggggaggatgcatgaggggagaagggattgaccccaagacctctgggctctggacatcatcaggcaaacctggagcttgggaagagaggcaggaaagagaaggatcttgggcccaggcactgcagccccatgccctctgtccctgcactgttgactcagcccctccacacttcccctttctttctaccattttctgccccaagcaccaggcccgtgcatctcttcccctcctccacctctcagctgctggcgtggcctcgtggcctcggctgagtcagtactggtctcctagagtccgggctgagtgcttcccgctgaactgtaatcctctgtccccagtccaggtcctctgacttggggcttctaccctcagccatctggatcctgatttttgatttctgagagcctgggaaaccttggagggagtggtcttctcagcttctagtcctgctccaagagcggagggaaaatccagagatcagagtcacaactaaggaaggtcctagaatagtgggaagagtgatatccccctcttctcaccttctcaggctttttgggaatcacaggggcttgaagagggacagattggaggtcagggagaatgacttgacttgcagaggcaggggcactgggggaaatgggagacagcagagatggaaaatgcggctcagaggctccgaggaaggtgtgcgccatctgcggagatcaacactgaaggatggagggtagatgtcagaaaggacttcctaggatgggagagaccagttgggtaaggagcaatagaggaaactctcctaggttttaactctggaaagtagtatgagagggataaaagttagactgcaggagagattttccgctggaagcaaccaagatggctggctgagcttccttacttaaagatcccagagtggaagagtgacccaaaggcagctagctgcctttgcctcaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaagtaagttgtttggaccctgagagtcacccagactcggtgcccactgaccctgatcttttcatctgttttttctgcctggatccatgagggtcactcttctctctgatccccagctgggcccaaatgccagggccagttgcttgatcccttgctccctgtcctcactctgaggggtggtggctgttggaatatggcataagccggactatctgggaatgtgggggaggggaggctgtgctggctcctcttgcagctgtcatccaccaggcaccccccttgctccccgaacagctgctaagggttaggggaactgattggagaaggagcaggaatgttgtatgtgtggagggggtggggtggggggtgacagaggaactgggtggaaagctgccagccttgcagctggctctgcctgtcttcctgcgcagagctgggcattcaggacttcacagtccccttgcccctttctttctattgactatgggtggagcctgaaatctctgctgtttcaagcagaagatgtgattaggacccttcatctcaaatttctagtgagaaagagggaatgtagcagggatgtgtgtgttgaggggcaggggttagaattcctgcccttcatccacatctgagtgtagtcctgtctttagggagtataagccaggaattctttccttccccagtacacagagggctcctgctgccccctctccctcaattcctcctgaagttatggcagagatgcctctgattagagcaggattgaaggtattgtgacctgctactgaatagcggacaaaagctctagcctgtaaatccctatgaaacttggggaaggaacccccagaaaggaccagtgatgggcaacccgctcgggtccccttctacgctgtgggagctttgtcattttgctcttcacaataaagcttgctaccgctc

SEQ ID NO: 1468 - DNA, 693 bp, Homo sapiens
  ENST00000465079
tcccgtgtactgaagatccagcgtttagttctcctttgatttcctctccctctggccacccctgcccccaatcgtaaaaggggtcagtctgctcaggcctgctttgatgggaccccgaaggccaggaaggaactggtcctgggttttctaagagctgggggcggatggaattctcctgcctgcgggtctttaaagactgagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaagtaagttgtttggaccctgagagtcacccagactcggtgcccactgaccctgatcttttcatctgttttttctgcctggatccatgagggtcactcttctctctgatccccagctgggcccaaatgccagggccagttgcttgatcccttgctccctgtcctcactctgaggggtggtggctgttggaatatggcataagccggactatctgggaatgtgggggaggggaggctgtgctggctcctcttgcagctgtcatccaccaggcaccccccttgctccccgaacagctgctaagggttaggggaactgattggagaaggagcaggaatgttgtatgtgtgga

SEQ ID NO: 1469 - DNA, 571 bp, Homo sapiens
  ENST00000495070
agtttgggtctgggctgtgcttatgccaacaggaagggctgggctgggggcaagcaacagggctgggctgaggcgaggcagtgttcctccctggtgcccgtcactggccactggatacagacggtagtggtggcgatgtgtgtttcaggaggagactgcaagcatcgggatgcccaggccccaaggaggccctcttcctgcagatccgagaaggactggacacctttctgggactgcagcaccagggtggctacgcctcccggctggatcaggattcctgtcatccatctgctggccctttggaccactcggccactggcatgctttccaagtctgtacccgtgagtggcatcaactgtctcttggaccgttcggatacagatgggaatgtatcccagtcctctgccattgacctcaggaaacgctgcagccagctggaaggacattcaggtacccgggtaggctcctccctgcgacagaccttcagcttcctctcgggcatgaccggaaaggccaagacccgggaaaaggagaagatgaaggaagccaaggatgcccgctataccaatgg

SEQ ID NO: 1470 - DNA, 420 bp, Homo sapiens
  ENST00000423422
cccagcaatcagagcctccaggcccaggaggatgaaaagaacatggagacgagaggctccaaatggagtagccctctgccagctcacatccctctttcaggggctgcagcttggacatcccaagactggccaggttacagcccacaggaggcgaggagtgctcccctttacctcaggaagtccgatgtccgccccagctgtcttctgccccagggaaagcagtgaaggaggagactgcaagcatcgggatgcccaggccccaaggaggccctcttcctgcagatccgagaaggactggacacctttctgggactgcagcaccagggtggctacgcctcccggctggatcaggattcctgtcatccatctgctggccctttggaccactcggccactggcatgctttccaagtctgtaccc

SEQ ID NO: 1471 - DNA, 490 bp, Homo sapiens
  ENST00000609126
ggcactcctaagtccagctgactgtgacacacttctagtcccaaggtttcagagttctagaaccctgctcactcttatttcctgctgacgcagactggtctgtgtgtgtctcccacgaacagagccgtcccagacgtgttctgagcaggtggagacaaggtgcccgtgaggccacactggcctctgcctttctgcagttgaatccagagaacaactggaggaagaagagatggggaaataaaggaggggaatggctcgcatgctgtacccctccaaaggtcaggggctttccgggcccacggccgaaaacaaagacgtcttcagaagacatagttgggggcctggcagggagctcgagggcccactgaatacgaggagactgcaagcatcgggatgcccaggccccaaggaggccctcttcctgcagatccgagaaggactggacacctttctgggactgcagcaccagggtggctacgcctcccggctg

SEQ ID NO: 1472 - DNA, 1645 bp, Homo sapiens
  ENST00000368315
atggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctggga

SEQ ID NO: 1473 - DNA, 5254 bp, Homo sapiens
  ENST00000356448
agaactctgcgctactgcccacgcatctcacaaagtctactacgccgcgcgttctcggtttcaacgcacctccaggattcagggcttcctaagctgcaattcagcagggctcccttgcttgttctcactctgtgcccccggcaacgaccccgcgcgcctacactcccgtgccgcctcagctactagtccgcaacttctagccccaaaacgctggagctcagaacccagctcaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaaaaaaaaaaaaaaaaaccttcccaaatgagctgataaaaaactgacgtgaggctgctttgccttcaataatacctagttttcagctgttccaactcgtttccaaatagaaattagctggaacacactacagtaatctcaaggaagggaaaattaggccttaaaagataccaagaagtcagcatggtacccaattgaaaccttttgaccttagtgggaattcattctatttgcactaaaagccttaacttgctgtattcagagtccctcttaactgtgagtttctatagaactttactttttccactagtgcacagagagagaaaggttatcttaatagtcggtttcatggagatgaaggatgggagattaagaggggggaaatgatttttactggcagctatattccctctctgttctatttgctttaacaaagggataaaacctggcaaagtgtacattattggaggactcaaatctgtatgtgacatgtcccaactactgtccgctaactagttatccaaattgtaaagctacagaagcccagttgaggggtaagtgtgcctggctcacacagcctgcaccctgtcacctcggcaatgagccagtgtggggcactggggacttctaacccttggattgctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataagaatgttaaacagctttggaaatacatgcatcttatgaatcatagccttatttagcaagatcaatgttaaagtgttgttatatggcaagtatttaacacattcacagtgtttgtttgatttcaactgtgaattgtcttaagttttttcaaacctagttgtttctatggacacctgctctgaattgtacattgacttcattactaaagaacaaaaatgttcatttttgtcccagtaaattgagactgcttgtacactttcagaaaaatatgtgaatttataaagattttgtagatacttgt

SEQ ID NO: 1474 - DNA, 3929 bp, Homo sapiens
  ENST00000465093
aagtgtgggggcgtagtcaggcgtgggggcgggccggcgccggcgccgcggtcggcggcagcgctctcctaagctctcgcggctgcgcttcggtcccggacccgggccacccacggggtagtgggtgctcctcggccccggacattgcaagccccagaaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaaaaaaaaaaaaaaaaa

SEQ ID NO: 1475 - DNA, 3781 bp, Homo sapiens
  ENST00000496710
ggcagcgctctcctaagctctcgcggctgcgcttcggtcccggacccgggccacccacggggtagtgggtgctcctcggccccggacattgcaagccccagaaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctgtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaatt

SEQ ID NO: 1476 - DNA, 2353 bp, Homo sapiens
  ENST00000465817
ggctgcgcttcggtcccggacccgggccacccacggggtagtgggtgctcctcggccccggacattgcaagccccagaaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaagagaaaggttatcttaatagtcggtttcatggagatgaaggatgggagattaagaggggggaaatgatttttactggcagctatattccctctctgttctatttgctttaacaaagggataaaacctggcaaagtgtacattattggaggactcaaatctgtatgtgacatgtcccaactactgtccgctaactagttatccaaattgtaaagctacagaagcccagttgaggggtaagtgtgcctggctcacacagcctgcaccctgtcacctcggcaatgagccagtgtggggcactggggacttctaacccttggattgctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataagaatgttaaacagctttggaaatacatgcatcttatgaatcatagccttatttagcaagatcaatgttaaagtgttgttatatggcaagtatttaacacattcacagtgtttgtttgatttcaactgtgaattgtcttaagttttttcaaacctagttgtttctatggacacctgctctgaattgtacattgacttcattactaaagaacaaaaatgttcatttttgtcccagtaaattgagactgcttgtacactttcagaaaaatatgtgaatttataaagattttgtagatactt

SEQ ID NO: 1477 - DNA, 3106 bp, Homo sapiens
  ENST00000483068
agcttttactttcagtaaacttaaaaggatttcaatttagctttggtcactgggtttttctccttttgtagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaaaaaaaaaaaaaaaaaccttcccaaatgagctgataaaaaactgacgtgaggctgctttgccttcaataatacctagttttcagctgttccaactcgtttccaaatagaaattagctggaacacactacagtaatctcaaggaagggaaaattaggccttaaaagataccaagaagtcagcatggtacccaattgaaaccttttgaccttagtgggaattcattctatttgcactaaaagccttaacttgctgtattcagagtccctcttaactgtgagtttctatagaactttactttttccactagtgcacagagagagaaaggttatcttaatagtcggtttcatggagatgaaggatgggagattaagaggggggaaatgatttttactggcagctatattccctctctgttctatttgctttaacaaagggataaaacctggcaaagtgtacattattggaggactcaaatctgtatgtgacatgtcccaactactgtccgctaactagttatccaaattgtaaagctacagaagcccagttgaggggtaagtgtgcctggctcacacagcctgcaccctgtcacctcggcaatgagccagtgtggggcactggggacttctaacccttggattgctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataagaatgttaaacagctttggaaatacatgcatcttatgaatcatagccttatttagcaagatcaatgttaaagtgttgttatatggcaagtatttaacacattcacagtgtttgtttgatttcaactgtgaattgtcttaagttttttcaaacctagttgtttctatggacacctgctctgaattgtacattgacttcattactaaagaacaaaaatgttcatttttgtcccagtaaattgagactgcttgtacactttcagaaaaatatgtgaatttataaagattttgtagatacttgt

SEQ ID NO: 1478 - DNA, 3106 bp, Homo sapiens; identical to SEQ ID NO: 1477
  ENST00000630534

SEQ ID NO: 1479 - DNA, 2353 bp, Homo sapiens; identical to SEQ ID NO: 1476
  ENST00000629129

SEQ ID NO: 1480 - DNA, 3781 bp, Homo sapiens; identical to SEQ ID NO: 1475
  ENST00000630729

SEQ ID NO: 1481 - DNA, 3857 bp, Homo sapiens
  ENST00000614308
ccgcggtcggcggcagcgctctcctaagctctcgcggctgcgcttcggtcccggacccgggccacccacggggtagtgggtgctcctcggccccggacattgcaagccccagaaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaatt

SEQ ID NO: 1482 - DNA, 3975 bp, Homo sapiens
  ENST00000618535
agaactctgcgctactgcccacgcatctcacaaagtctactacgccgcgcgttctcggtttcaacgcacctccaggattcagggcttcctaagctgcaattcagcagggctcccttgcttgttctcactctgtgcccccggcaacgaccccgcgcgcctacactcccgtgccgcctcagctactagtccgcaacttctagccccaaaacgctggagctcagaacccagctcaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaatt

SEQ ID NO: 1483 - DNA, 5246 bp, Homo sapiens
  ENST00000296794
aaaccttggcttcagcccggccgccgccaggcgttggcatcgccggggagagccttccggactccgggcggcggctggctgggggcgcgttccgaggcgccctcaggcagggcgcgggggcagagcctcgcctgggttctggaggctgcggggccatcgctccagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggtaattaacactttaaacatcatctgtatagtttgaacaagaagttgtccctctgaatggttggctcttgtgtagagtgaatcaaagtcctccctagcatgggaataaatcggtactgatga

SEQ ID NO: 1484 - DNA, 560 bp, Homo sapiens
  ENST00000509848
atcgccggggagagccttccggactccgggcggcggctggctgggggcgcgttccgaggcgccctcaggcagggcgcgggggcagagcctcgcctgggttctggaggctgcggggccatcgctccaggcccacagcgtccccgcattggttggctgggtgggccgaggaacagtggcaacatctgtgtttgtgcggcttctcccgccttgacccctgcctgggtatccacacatctcctcacaccaggagttatagaggttcaccacggaccacaccaattgggcaaaatccaaagaaaatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgacca

SEQ ID NO: 1485 - DNA, 5792 bp, Homo sapiens
  ENST00000437974
tcattgcagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggctccagtatgacaaagtgcagttgtacgttgacatctcccccgggactgtggactggaaccacatctactttgaaagatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccgga

SEQ ID NO: 1486 - DNA, 6118 bp, Homo sapiens
  ENST00000426542
tcattgcagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatgatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcatta

SEQ ID NO: 1487 - DNA, 280 bp, Homo sapiens
  ENST00000510131
gctcccatcagcagatcctgataattatttcttttgcagagattaagaattcagtgtccagcagatcagcagctgaaaaggaagatataaagcgtgtcaaaagcctggtggttcaacacaatgaacatgaagaccagcacagcctagatttgggtatgaaataacgcttttacctatactcgtaggggcatcccagatccaggtttagagtggacaagaagcaagtaaattttaacataaaatattccttcctggtaaccttatctatttcctgaaacgc

SEQ ID NO: 1488 - DNA, 4424 bp, Homo sapiens
  ENST00000296799
ctggctggggacgccccgagttcttcctgagtctctactgtttcatctgttgatttcaccaaaacaaaaagatggattctgactccgactcaccttttaactactcgtggccttcctttcccaaaatgaagattcgaagaaggacgtccaaacaagatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatgatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagcc

SEQ ID NO: 1489 - DNA, 710 bp, Homo sapiens
  ENST00000513841
atccacggaaggaggaggggctgaaggttaaattgatcactaattactaataatttaaccaatcatgcctgcataatgaagcttccataaaaacccaaaaggacgggccgggcacggtggctcacgcctgtaatcccagcactttgggaggccgagacgggcggatcacgaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcac

SEQ ID NO: 1490 - DNA, 536 bp, Homo sapiens
  ENST00000506334
attgctttgccaacattgctgcaacagatgtgagcatttattattaaagtggaaaagtctagggccaacctgaccctattcctttgttgataacccttgtcttctgccttatgcttgaggacttttcattttttaatcatatggatattatgagaatatgtctatagagtaggtgtcatttaattatttttcttaggaaacagtgagaacttttgatgtgtccttttgggcgctttttcagctttatagaattcttgtctatggtggctttgactgtcactgcttctgatctaatttttctgatctcttccttggactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtcc

SEQ ID NO: 1491 - DNA, 8285 bp, Homo sapiens
  ENST00000510312
aagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctgtaagtgaaaatgcaggccttggcaatgagcctgagcacagtccctggagcttacagtggtcacgtaaagtaaaggcaatgactgtctctggttgaaggggacttgatatatttttttaaattagaaaaaaactgagaataaatatgctagcctaaatgaatatcataggcatataataatgacactggggtttcaagtatgaggatctaaagagtagttggtgggttatactgctctgtttgccggccaaatatcggaccttccccaacccctaccctgcctcatttttgatatgatttattcattacagttttgaaagaactttttaacttttcaggttttttaaaaaaggagtccctgcggtcaattacagaacaagcccttaaacctaatctcatgtgcatcaactgagaaaacaactcagaaaaccagaaatatacacacggctccctccgtctccctcctttctctctccctctctctttctctctctctcacacacacgaagtttggtggtatggttaaagcagaagtgccagaaaattcttgatctgtgccatcctacactttagttcatgtcagaattcatttatgaaaacattgtttcaaaacattttaaatataaaaaaaaatagaatgtagagatttggtttaggtaatttccccgaacctagctatcctgttatatgtatagttgtaggctacttagttccataaaggtttctaagataagagcataaagagtatacttttcatcctgtgcaggtggtaacaaccttacttccacaaggtcttatgtgcgtaagataaaatggataaaatgtcttcagtagttagagatcagaagattaaattgaactcaagattggaagattaaattgaactcagaacttctttaacaacatcccttgattaattaagatatatagatgcagtatagctttttaattctatacttcttttttttttcttttttaaacatcagcaccactaattatcttcctctctcaagttctgctttatctaatcctgagtttctagtttcagaatgcgcacgtatgtttttcattttgacacagcccagattcatcaggggagttgtactgccctgggtgatttccttttaaaagaagaacctcattatgccattgaggagtctctgtctaaaaatacgtgcagggatctgctgagggatctgctgctctcagcctcgccccagggacagctggagaggctcccctctgcagctgcccgagcccgcggtcgtgccttccctcccttcaggccaggcagtgaaggtctccttgtctgtatccacatctctcatgactggggagagtttcaaagggacacccgtggcatttgccagaaccattgagaggctctttagaggggtctgatgtcgggattcaggtagaggaagtaccgaagctggctggtggggtcctgtaccccaaggcctcttcagttctgggtcagactggaacatggtgctatgagagtttgattctctttataaagttgttcaaggcacaaggctagttctaaatgaaggtctacaactgtgactgaatgggtcggttctgcaaatgacttggagaactgggctcttcttcatcaggcttatgtcagcctgaggttataagccaagcagacagctctattttcagtcttcagtatacatgatgagtatcttctacttctaggaaagttctgttcactggagaccctctggcccaccctgaaattggatacagggacagggacctgatctgtgttttattcttctgccttgtcatcagcttctttcccatttgattttcctaatttctatgagggagtgagaaacagagtggtgaattctttagtgatgcctttggccactctttaagagttaggaatagcacccaatagtagaaccatttttcaaatgacagagaaacctataaaatgtccctcattgtaagtgaataagtgctgatcagcttgaacaaaatggacttgtttttagctgatctcatctgaagccgtttccgtttagacaaaaacttctttgtattagaagaggtctttgaaatcctagaggactctcattttccaaagacataagtatttttattaaagaaaaaagcatttcctatattggaaataaagttttaaaaagacacaataaaaattatacaaacaaacagtgtcataaagtgaatatcgattttgtcagggtctggattggacatggttctaataaaacactgttttgggctttgaaaattctagttttaatcagtgcaaggtgggcacagtttaagttttaactgagttcacatgggtaaagaaataaaatcctgccaacagagatttaatggatgaagtgaaatctgtatttggtacttaaaaatatttcgggactagtttctatgttttcatagtttaaatacatagtatttgtaaatctaaagcataacaagaaatgtgagaaaaacaacacatttagaaattgttaaaaaataagttattcagagatagggacaggttcttggtttgtatgactatgagaccgtgaagtattagccatctccgccttcctagaaagatgtctccctcctgcttcggactcctccttcctcctaaaccttgtttatcgtctgctgctcttgcactggccacaagagagactttttacagacttaagtctgccaagagaccttgcttttgttctacagcacctgttttaaatttcacccttcccaggaggcattttcctattaagtgagagtgagatgtagattctaccctctgtaacacaaacgacacacgaacacttcagtgcaagaaagaaaagtacaaagatggtgatactttgtgcggttcgtcagttgctgtctgttagcgtgtaagccccatgtgggcagggaccacatgcattgctctgcgctcatccaagcacctcatctaagaatactcaatatgtattattttgtggtgtttcctattttgaaatatgtgttggccgtgtacagaagaacccggtgggctggccgatgtttgacgctgtcctttttgtttctgtctcgatggcgtgcttccagcattagtcacaggagggagagaaggaagaggctgttcggatgtggatcccgggatccagggtgtggtaaccgacttggccgtctctgatgcaggggagaaggtattgtgaactgatttgttagtaaacggcagcggttactgtgtataataaaatagcctcaggttctggtctgtcacggcagtcagtggggcaaaggtgcttttctgaattgttctcaattgatttaaatattcatatttaaactttctaacttatttcttcttcaaatgtgcttgcactgcctgtgtcatgtaggtgtaaacaaagcaacgattgaaaagttattaaaaagattaaaaactctcctgtgtatatgtgtgtctgtgctctctgacttctggtctttctgccctgcaaacctttgcttctcacccactatgtctggcagctctggcacccgggggcccttttgcaaccagatggcgccaaagtaattgaaacaccttttactttggaatattcttgcttctttcaccttccttgaccctcctctccttgcagagttgatttcctgtcaccacccacatttcacctactttttttgtggttaatttttaattaatctgaccagtttttgcttggggcacagcgattcccaaagggaatcctcttttttgacttactgctatagacatagatattaactctctctttaagaattaaatacataaaacttcctattaatgtctactgaaagtgagatgtcagaaatagggaaggaataaaatatgattctgggaggtggctagttggcctcttcctgcttgtcagggctccagagtttagctttatctaaaattgaattaggtacattaataggtgccaatatgtgtcaatgtgaaaaaatggcaaatgtcagatcttctcacatatacaacatattttacatattatatactttttgtgtatattacataagactgagaaatcaagtcaaggacttttaaaatccagagaaaagacagctgtgactgagtgttcttttttaaacttcagaggccaaaatgagcataggaatgtaatattttactccttctgattgtaagctttctaatgtattgcttcttaaaatgttcctgcttttcatcacttttaagtgtgaagtttgtggtgtccaactgtgttaatagaaaagagagagtgaattggacagtaataatttaatcttgaacgcaaagttgggtggctcctacccctaaagtctccctcttccactccaattcagctacaggtagataattgaggttaagtgtctgggttcttctttggattaagctatctgcaaaattttttgcttaataaggcattttgaaagattaatacattaataaacccaggtaaagggcaggatcacttgaaatcaaacttttaaaaggtgtataatggatattttgtcattagcttcctctacaaggtaaggttagaacaaatttctgaaagaatattaaaaaatgaaatctgactcaaatgcagaaataatggataaatcgccaactgcagttttaaacatttaccacaaggtggcagaacaactccattaaaaacgcgaaatttcctgtcttgtgtcaaacctagtggcttttgggcataagtaaccgcgggtagcacagtccaactcatttctatggttctaatttttatagactataaaaactctgtgccatatggtcttactacagaagcagtggagtgtggatgggccacgacagagccagaagagcagcgagaacgccaaccatccctctagggcgggggttcttagagcctgttctctcccatagggtttggcacagatctaatgtctttaagcttcatctccattttcagcctctgtcttttctctatcagaggggctgcttacgagtgaaatctttaattggcagtccaagggaagcggaggtctggctagctcatcctggcatcatcagcctaaactaattgaatttaacaagttcaaaattacccgaggacatgaccatggctggctgctttttatggcttaaaattagatgagacagtaggcccttgaggacagggcatctgatggtctcccatagcgtaaggtgtgaagtttacagtgggtgatcgatatttatttattgaatggcgtgccatcgagttcaactgggagtcattcacttgttgagtgtccgtgctatgtcaagcatcattcttataatatggagcacatggacaaagtctcgctactcactggtttgcatcctagggagagaaggccgacaataaatgaataaacaagtgttcaattatggaggctgcaaaccatcactatccacgtgtgcccttaatgtgtgctgtggaagagacaaagaacaaggcatagaccctctccctaaagaacagacggtctcctgtggctggttcgtggcctctgctgctagtacttctactatggcagtcactggtctggtgatctctgactgtggtgggatctagagcagcccagctacgcgcgccactatggccaccgtctgagtctggtttcttttcccaactgctgtatatgttgatatcgtgaatctcaaacattgagaaaaggagttaaggccagacatgatattctttctttaactttcaatctgtcctctagaatataagaggtcagcctgacccaaaagacaacttcagtctgggcacagagaactcaattcacattgtggtttgcacaaggtaaatgttgttacttgagttttcagggtgtccttactgtcatcccttgttgttttaaggggtgattgggtgaaaattgccatccatctcaaacatcgactttgcgtgaaggacgctcttgttgtcaagtgtttgtttgattctataggcttttatttctgggaggaaactgagtcagtatagataaggtaatcaagtttagagatagcaaagtgatttacccaaggtcatacattttgggacactgcagggcagcttttcagaagtagaatggttattcattttcttgttttttatgtattttaggtggaatgtagaaattttccaggttcttcacaatcagagattatacaagccatacagaatttaacccgtctcttatacagccttcaggtaactatcctcctctaatctttgaccttgtgaatggttctcttaatgcaattctctttgatgattcccagactttaaaaatgagaacaagtgagaggtagggaatgatcttaaaagaatgacaaccttctaagtgtgatgtgttggactcacatggttttgtaatcagaggcaacaccatgactacattttataccattcttctctgaaatcataaaacagttcatatctttaaaaaatattgatgaatatgatctggcttgacatttacaatgaaactcttaggtgagtgtagcatgacttcacattttctgatgaaaacctaaattcacacctaaaattctttgacttctccatgtggccatcagcctttagagcagttaagtaatccatatgttgctttactcttttgtttgttcatccactcaacatttattaatttattaatgttgaggggatgaacacacagtgcctgtctctgtgctgactgtgctgagggctgagcacacaaaggcaaattagccacacagcctgctctcaaatagcttactgcctttcaaggaagagcagacataaaaaagaaatcatgcttgcatttaggattaaatggttggatgatcccttaggctggggtccccaaaccccagggtgcagagtgttacctgtctgggctgcacagcaggaggtgagctgggggcaagcgagcagtaccacctgaactccgcctcctgtgagatcagtggcagcattagattcttataggagcgtgaaccctattgtgaactgtgcatgcaatctagggatctaggttgccccctccttatgagaatctaatgcttgatgatctgaggtggtacgctttcatcctgaaaccattctcaccacatcccagcccatccattaaaaaaaaaaaaaaaa

SEQ ID NO: 1492 - DNA, 2936 bp, Homo sapiens
  ENST00000512883
atgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggctccagtatgacaaagtgcagttgtacgttgacatctcccccgggactgtggactggaaccacatctactttgaaagatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcatta

SEQ ID NO: 1493 - DNA, 539 bp, Homo sapiens
  ENST00000504003
atacaggtatttttataaaactttcatacttagactaaatcttagtcttttgatttttattcagtttatttgaactgtggtttgcttcattaatactagtaatgttttttctttaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaaggtacagtgcaggcacttctggctccctggtcgtggtgttctcctgggtgttgggaaagcctgagtgtcatgaa

SEQ ID NO: 1494 - DNA, 1926 bp, Homo sapiens
  ENST00000503341
tttatccctaggagagaaatgatttctcatatggggtcaaaacatacacacatactcagtatgtgtccattttcaatttgtcccttctgtactgctttgcactctaaatgggaacttttaaaattaaaagcttccaagggcattcacagagatctctttggttttgtggaatccttccaaatcttggtaattatttcctgtgatgttgccaaacttttcataggcagataccgtaactcaaaatgtttttttaatctggttggtaatgtcctctgggctttagagtatctattttcccttaatcatttcagcctcctgttagcgatctattaaacaaataaatttcagcttagttttttgtgcatgaccttcctgctataatacaaagatataacagtaatgagactagctttagccacttacatatctcctaaaaatggtattaactgctattcttaggcattatgttataaaaacattatttacctaaagtctccaaatagttgttttttatttttatgtcttcataatgcaatgtagctcaagtaatttctggtttgggactcaaaggaaggatactactaggtttatgtggattcttaagttctcatgaatgattgactagggagagacctcagcaagagagtgagatgtaggacaggaatgcacagccttgtgaatttatgtgccgagttcgtattcagaagactcgcttaactatcacccaaccaccagcagcaaactaccttcccacaggagaggatgatattgcttttgggctttgtttcttttctctataaattcacaggtcctacccctaggacagatgtagacacacctctctggaacgccaaaaaccttgcctttggaggtaacttagaaaaaggccagaaatattaagagaagtgaattcgggcctgcgttttgtgtttcgaggtagttccaaccgaaagggtaaacaataaccatggaaccttgtgttcagtgatttttcctctgtctgctctgacaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggtaattaacactttaaacatcatctgtatagtttgaacaagaagttgtccctctgaatggttggctcttgtgtagagtgaatcaaagtcctccctagcatgggaataaatcggtactgatgagctgg

SEQ ID NO: 1495 - DNA, 6351 bp, Homo sapiens
  ENST00000545377
aaaccttggcttcagcccggccgccgccaggcgttggcatcgccggggagagccttccggactccgggcggcggctggctgggggcgcgttccgaggcgccctcaggcagggcgcgggggcagagcctcgcctgggttctggaggctgcggggccatcgctccagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggctccagtatgacaaagtgcagttgtacgttgacatctcccccgggactgtggactggaaccacatctactttgaaagatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcatt

SEQ ID NO: 1496 - DNA, 6273 bp, Homo sapiens
  ENST00000513042
aaaccttggcttcagcccggccgccgccaggcgttggcatcgccggggagagccttccggactccgggcggcggctggctgggggcgcgttccgaggcgccctcaggcagggcgcgggggcagagcctcgcctgggttctggaggctgcggggccatcgctccagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatgatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcatt

SEQ ID NO: 1497 - DNA, 3602 bp, Homo sapiens
  ENST00000296315
cactcggctccggagcccagtcgagtcctgcccggctagaagccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctacccccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatc

SEQ ID NO: 1498 - DNA, 3639 bp, Homo sapiens
  ENST00000338458
agcccaggggagccgccgccgcagccgccgccgccgcggtgagttttccagcctggagaggccgaaccagcgcgggggtcgaggagacctgagcctgccatactgagtctatggacagttccacagcaatgaatcaatgcagctgtagaggaatggaagaaaacaaggaaaggcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatc

SEQ ID NO: 1499 - DNA, 3992 bp, Homo sapiens
  ENST00000413728
gcagaagagctgtcagatctttcccttcagcacttaaatcattgtcacgcaatggctttcatcttgggagattcatcctctgcattttggaactgagccttcctagtgttctgagagttttctgctgtctgttcagcttagcacgctaagaagctggagaggtacccagcagcctggttgcattctccgtcttggaaaagtatttaactgctttgagaaatcatggaatcgtttctggccacattgtgagattgtattgaattttctttttaagtttttaaatttttatatgcaaatgctggaaagcttggagacagtctatttcaaagaaggctgttgatttctgagactggcaggggcataaaatgacatgagagtgtctcagcaggattccaaattcacgaaagatttttccaggcacctactatgttcagaacggggatgcagaaatatcctggagaatctgaagttctgccttaaccctcgaaactttgaaagcaatggctgaaaaggaaagatgaatacctagaggctccctctggaaatgattgaggtttgccaccacaattggctactttggctttgcccatcaaaatttggtatcttcatgtgctgtctagcatctactacaggtcagatggagcttaggaggacaagggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtc

SEQ ID NO: 1500 - DNA, 2693 bp, Homo sapiens
  ENST00000465659
agtcgagtcctgcccggctagaagccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctacccccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctg

SEQ ID NO: 1501 - DNA, 1994 bp, Homo sapiens
  ENST00000496106
atgcagcccaagtggcggggaggagttccttcagggaaactatgctcagccctgttcagagaatcctgtgcacagggctccactgcagttaggagccggtgagtccgggtggatgaggtcagagcgccccatggtgtggtgctgcctctttgtccgttcgcagcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggatttt

SEQ ID NO: 1502 - DNA, 2197 bp, Homo sapiens
  ENST00000497267
aactgagccttcctagtgttctgagagttttctgctgtctgttcagcttagcacgctaagaagctggagaggtacccagcagcctggttgcattctccgtcttggaaaagtatttaactgctttgagaaatcatggaatcgtttctggccacattgtgagattgtattgaattttctttttaagtttttaaatttttatatgcaaatgctggaaagcttggagacagtctatttcaaagaaggctgttgatttctgagactggcaggggcataaaatgacatgagagtgtctcagcaggattccaaattcacgaaagatttttccaggcacctactatgttcagaacggggatgcagaaatatcctggagaatctgaagttctgccttaaccctcgaaactttgaaagcaatggctgaaaaggaaagatgaatacctagaggctccctctggaaatgattgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactc

SEQ ID NO: 1503 - DNA, 2024 bp, Homo sapiens
  ENST00000495373
agtcgagtcctgcccggctagaagccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctacccccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaagtatggatagcagtcggggttgacctgttgaatgtttttggccgtggtagtttggagggagtgggcagctggtggaaagagaaaagccacggtcttgaagtcaaactgcatttgtatgctatttcatcacttcctgattatgtactttgtttagtccctgtgattctcagtttctcatctccaaaatggaaatgcataggtacctccttcataagattgttataaggatttagtaagataatctaagtgaaactgtctgcacatagttagtgctccttaagttccctttctctgtctttttccattggataaaaacatgcttaataccagatagtccctacatggatgccagttgcgttatggtgggttttgcagctgaactggtaaacttgtccctaaagagacataagaatggtcaactggaatgtggattcatctgtaacattactcagtgggcctaatttaagacttaataaacaaattaactaaaagaagccaagatagcaatatctatcgagtatctaacatgatactcggtgaaacaagcaggtaacttccttcccctatggagcttgcattgtgatggaggagaaagatgataaacaaatgaatactccaggtgttgttaagaaaacttaaaacccg

SEQ ID NO: 1504 - DNA, 667 bp, Homo sapiens
  ENST00000468727
agcccaggggagccgccgccgcagccgccgccgccgcggtgagttttccagcctggagaggccgaaccagcgcgggggtcgaggcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagc

SEQ ID NO: 1505 - DNA, 669 bp, Homo sapiens
  ENST00000473779
aggagcccatctggtgagctgagagttagtgaggggcccaagagaatggggcttgctctgccctgtgctttagatggaccatgtttgatagaaatatttggcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaag

SEQ ID NO: 1506 - DNA, 567 bp, Homo sapiens
  ENST00000481422
atagtaacaatgggggagaaggggcagtttctagaaggagaaggaggcactggagcagatacaaataattcctgcctacaaaattcttccctatctgtcctcctatcataaaagcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagag

SEQ ID NO: 1507 - DNA, 787 bp, Homo sapiens
  ENST00000498517
agtaacaatgggggagaaggggcagtttctagaaggagaaggaggcactggagcagatacaaataattcctgcctacaaaattcttccctatctgtcctcctatcataaaagtgtcagctttcatgactgacgatgcatctacaaggactggagttgaacttcaagcaagagactcacagacaaaggcgccctgggccagtggcacacactagctttatcaaagagactcagggacaagtacgcctggtctgtactgcggtttgccaattagctggatgaacagctggctaatttctgttttatctcttgggcagaagacacatgaggctagaataggttatcttcaacggggagccgagctaaggcctcatcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggtaaatttaa

SEQ ID NO: 1508 - DNA, 757 bp, Homo sapiens
  ENST00000477833
tccccgcccccggccccgcccagcccaggggagccgccgccgcagccgccgccgccgcggtgagttttccagcctggagaggccgaaccagcgcgggggtcgaggagacctgagcctgccatactgagtctatggacagttccacagcaatgaatcaatgcagctgtagaggaatggaagaaaacaaggaaagggctgttggaggtgtttctggaaccagcgcaatcaatggcaggaacaactggtttttcaggctattgagaaagtctgatttatgtggctgaagtatggtgttattgacccccccaccttcgactcctaagattccagaacaaactgagaattcatgcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggag

SEQ ID NO: 1509 - DNA, 587 bp, Homo sapiens
  ENST00000477440
actttcttctccagccccgcggggcacccgcaggtcagcgtcgcgtcgggcgctgctggtggcggctcacagggccgcgggtcacttcgcggcgggggagccgggctcagggcgctccgggcggcgggcgccgtcccagcctgcctgaggcccttgtcccggcggctgcatcttgtaaaccgagcagccagaaaatcccgagataggacaccagggtggaggacgccaaggggttaaggtcagcgtgggtgcctcgcagccagagacgggcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgag

SEQ ID NO: 1510 - DNA, 514 bp, Homo sapiens
  ENST00000468466
ttttccagcctggagaggccgaaccagcgcgggggtcgaggtttattgtgtgcatccaccaaggagaatgtaggattcaagaggacagaggtgtgttgtcctgttgactactgactcctgctccatggcatacagcgggtgcacaataactgtcctgagtgaatgaacacccattgactgaagtgaggagacctgagcctgccatactgagtctatggacagttccacagcaatgaatcaatgcagctgtagaggaatggaagaaaacaaggaaaggcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcag

SEQ ID NO: 1511 - DNA, 428 bp, Homo sapiens
  ENST00000486829
aggagcccatctggtgagctgagagttagtgaggggcccaagagaatggggcttgctctgccctgtgctttagatggaccatgtttgatagaaatatttgtcctgttatacttcatgtaaagagaaccaactcagtattggctctgcgcctggtacatagcctaaacggcagcggcaaaacaactttcccatgtttccctctcctaaagcctggaatttcagagggttcttccagggatcaccccagaagaaaacagctgatacttacatctttgctccaggatctgctttaggggaactccaaactaacagcagcgaaaacggaaacagagcacccaagatgaagatgctgttagcctttgcagtctcgacataagtgagcctagtaataaacgggtcaaacccctttcccgagtcacgtcgctagc

SEQ ID NO: 1512 - DNA, 4484 bp, Homo sapiens
  ENST00000409978
aggggaagtcaagcctctctactgcttctttttataacctttaagttaattcagaacccagataagccttgatctgaggatgatataaccaccgcaggcaacatgggaacttctagagaaaacaagaagaagacttcaaaaaacatgctgtgatgtctcccagtggagacagggcacgaggtgcagggaagaggaggtggcctgagccaggacgatgaggatgcaatgttgaagaataagctggagaagagaagtaaccggcactatggaaaaaaccaaaacaaagcaaggagagaatgaacatatgccggtgaataatccttccacgcagatttaccagttgcaggccctagcctccgaactcaaaactggtttcacagaagcaatgcaagaactgtcaagaattcaacatggagaatatgctttggaagaaaaggttaagagctgcagatgttccatggaagaaaaagttactgagatgaagaattcattaaactatttcaaggaagagctgagcaatgccatgtcgatgatccaagccatcacttccaaacaagaagaaatgcaacagaaaatcgagcagcttcaacaggagaagcgaagagaatctcgaaaagttaaagccaagaaaactcaaaaagaagagcacagctcacaggccgggcctgcccaagcacaaggaagtccttttcgttctatcaatatccctgagcctgttcttccaagcgaagactttaccaaccttttgccttctcaggcctacgagaaagcccaagagtccagatctgttcatgtaggagacagtaatgtaaaaggaatgatgggtcctggagtgaacccaacaactccagaagcagaagaaaacctcaagtcttgcctctcggctgatatccagtccaagggccatctcccatctggcatgtggaggcagcctaaggatggtaaagaatggggtgaagaatacgtcacaaaagaccacccagataaactcaaggaggctggccagggtagacacagctccttggaaaacgttttatgtgaaacctccttagctgctaaaagacagactgtggccctggaactgcttgaatctgaaagaaaatatgtcattaacatctctctgatcttgaagataaaagccacattccaggggtcagatggaaagaggaattccaaagagagaagcctcttccctggctctttacggtacctcgtccagcagcacctggatctgcttcacgcactgcaggaaagggtcctgaagtggccacgccaaggcgttcttggagatttattccttaagttaacaaatgacgagaataatttcttggattattatgttgcctacctaagggacctgcctgagtgcatctcattggttcatgttgtagtcctgaaagagggtgatgaagagattaaatctgacatctacacgttgttttttcacatagtccagcgcatccctgaatatctgatacatctgcagaacgtcctgaagttcacagagcaggagcaccctgactattatctactactggtgtgtgtccagcgcctccgagtatttatctcacactacaccctgctgtttcaatgcaatgaagatttgcttattcagaaacggaaaaagctcaagaagtcatccatggcgaagctgtacaaagggctggcttcccagtgtgccaatgctgggcaagatgcttcccccactgcaggtcctgaggctgtccgtgacactgggatccactcagaagagttgctgcaaccctacccttctgctcccagttctggccctgccatcacacatctgatgcccccagtgaagaaaagccaacagcagcaaagcctgatggagagcatgcagcccgggaagcccagtgactgggagctggagggcaggaagcacgagcggcccgagagccttctggcaccgacgcagttctgcgcggccgagcaggacgtgaaggcgctggccgggcccctgcaggccatcccggagatggacttcgagtcctctccggcggagccgctgggcaacgtggagcgctccctgcgcgccccggccgagctcctgcccgatgcccgcggcttcgtgcccgcggcctacgaagagttcgagtacggcggcgagatcttcgcgctgcccgcgccctacgacgaggagccgttccaggctccggccctcttcgagaactgctcgcctgcctcctccgagtccagcctggacatctgcttcctgcggcccgtcagcttcgccatggaggccgagcggccggagcacccgctgcagccgctgcccaagagcgctacgtcgccggcgggcagcagcagcgcctacaaactggaggcggcggcgcaggcgcacggcaaggccaagccgctgagccgctctctcaaagagttcccgcgtgcgccgccagccgacggcgtggccccacgcctctacagcacgcgcagcagcagcggcggccgcgcgcccatcaaggccgagcgcgccgcgcaggcgcacggcccggccgccgccgccgtcgccgcccgcggcgcatccaggaccttcttcccccaacagaggtcccaaagcgaaaaacagacctatttggaagtaaggagggagatgcatttagaagatactaccagattctgtcccaaagaagaaagagaaagtgaacaaacatctttcagcgatcaaaatcccaggcaagaccagaaggggggctttcgcagctccttccgcaagctctttaaaaagaagtccagtggatcagaatacagggaaaaaactaatgagaatccctcaatggatccttcacccaccaaacaagatttcttcagaaaccgacttgctcttgcaaatgaccttgaccaaggaacagctgtgtaaaacatacttaaagttgtattgtcaagtggtaagatgaggataaaaagcttgtatatatctgtgtaggaatatatatatatatctatatctatatatatatatatatcgatgtataaatccctgaggaaaactaatataaatacttacatatgaaactaaacatacaagacattgaagagatgaagattagtttctggttaagatctggctttttgaacctcaacactggggaaaagggaaatgaagacttttcacatcattacagaaaaacacaataaatttggaggaaaataaatgtttgtaagaatgaaaacttccaacttgaagtcattccccgagtataatactgagcatgttcatatttaacatggatttgaattttatgcttcctaggcatttaacttattaactcatccagtgttcttaaactaatatacactatgttaggggccagttctgtcttgcttcatgtcttccaaaaaccctaaggcaatatctaacatcccttaaggcaaaggattaattaacagaactgtattttatatgttgcatatctgagttatggagaatttgtgcttaaaccatgattcagaaggttcaaagcttaaaaacacattgatctccaaacttgttctgtggttatggaaatcagtaaagggaacaaggatttctgtagaaactggggagagaggaaggcaaagaaacattttcccttgtgtgggttgagctgaggatggaaacagtccagtctgtgttttattgagtactcagtattcaagacccactcgtgatcttgagtgtcacacacactcacaaccagatggactaggaaaaaagcagtgatttagccacatcttgttaaaaagactttctgcagcctgaaaagaaggtggcaatagcaccaaaacttcaatggctcacacacagcagttgctacaaacagcaggtcaaagtgaaaattcaggattgcagcacttgactgttttcctattttgtaaagaaaccaagctcttaaagcttagaggaatcagattgcaacgaggcctgcctggctctggggtgataaaatgtgctctgtttccacatggatatgtgcaagatggtcagcatccttgatatgccccaaacatcagatttataatagaaaaaaaattgggtttaaacaatttgtctttattcccaggcagttcggtatagtaaattaggggtatttggtttctgttcattcaaaatcttggtactcaaactggtgtcttcagaagctgttcctctattgaagcgtttgttgataaaataggcaaaggttcacatgtaagtgttgcaagttttcttctccttgtctgatgacaaattaggaactcacctactgcgttttgaatagtagttgtctggaacacataaaggatcactgccaagttttttgagtttccaggatctaagtttaagccaagatttttgtttcccagaagtttatgaattcatttgaaattagatttttctcttattatgtggccggcagtgcttgcaagcacaacgccaaatcgactggacgtggaaagtgaaatactacagaagtcacaatctattaaataaaatgttaacataa

SEQ ID NO: 1513 - DNA, 615 bp, Homo sapiens
  ENST00000488692
cactagtaaatgaggtctgtagattttcaggaggcttgtttctcaaacaaaagaaaaattcaaggtccaatggtgccacttacagtaatttccagcaaattgaattaacttttcatgcattatttagttgcaggccctagcctccgaactcaaaactggtttcacagaagcaatgcaagaactgtcaagaattcaacatggagaatatgctttggaagaaaaggttaagagctgcagatgttccatggaagaaaaagttactgagatgaagaattcattaaactatttcaaggaagagctgagcaatgccatgtcgatgatccaagccatcacttccaaacaagaagaaatgcaacagaaaatcgagcagcttcaacaggagaagcgaagagaatctcgaaaagttaaagccaagaaaactcaaaaagaagagcacagctcacaggccgggcctgcccaagcacaaggaagtccttttcgttctatcaatatccctgagcctgttcttccaagcgaagactttaccaaccttttgccttctcaggcctacgagaaaggtacagttcacaaatcatactgaattaatcaagtatttttttcccaattcccccaatt

SEQ ID NO: 1514 - DNA, 659 bp, Homo sapiens
  ENST00000486958
ggagatagagaccttcacagcaaactttatctgagacatctctctatcttttttggcataatatgtgttcagagagccagtttgccactgtacaacctgagaactgttatttccattctgttaggtcatccatggcgaagctgtacaaagggctggcttcccagtgtgccaatgctgggcaagatgcttcccccactgcaggtcctgaggctgtccgtgacactgggatccactcagaagagttgctgcaaccctacccttctgctcccagttctggccctgccatcacgagatgcatttagaagatactaccagattctgtcccaaagaagaaagagaaagtgaacaaacatctttcagcgatcaaaatcccaggcaagaccagaaggggggctttcgcagctccttccgcaagctctttaaaaagaagtccagtggatcagaatacagggaaaaaactaatgagaatccctcaatggatccttcacccaccaaacaagatttcttcagaaaccgacttgctcttgcaaatgaccttgaccaaggaacagctgtgtaaaacatacttaaagttgtattgtcaagtggtaagatgaggataaaaagcttgtatatatctgtgtaggaatatatatatatatctatatctatatatatat

SEQ ID NO: 1515 - DNA, 509 bp, Homo sapiens
  ENST00000483305
caaagggctggcttcccagtgtgccaatgctgggcaagatgcttcccccactgcaggtcctgaggctgtccgtgacactgggatccactcagaagagttgctgcaaccctacccttctgctcccagttctggccctgccatcacgaacgtaatttgtttctgagtgtgaagatccacaagtcgaacagaagttgagttttccattattccgtatgactctgctagggcaagcaagggagagaagagagttgaaggtgtgccttggagcaccgcaggtgacatctgatgcccccagtgaagaaaagccaacagcagcaaagcctgatggagagcatgcagcccgggaagcccagtgactgggagctggagggcaggaagcacgagcggcccgagagccttctggcaccgacgcagttctgcgcggccgagcaggacgtgaaggcgctggccgggcccctgcaggccatcccggagatggacttcgagtcctctccggcggagccgctggg

SEQ ID NO: 1516 - DNA, 514 bp, Homo sapiens
  ENST00000411874
cggccgcgcgcccatcaaggccgagcgcgccgcgcaggcgcacggcccggccgccgccgccgtcgccgcccgcggcgcatccaggaccttcttcccccaacagaggtcccaaagcgaaaaacagacctatttggaagagatgcatttagaagatactaccagattctgtcccaaagaagaaagagaaagtgaacaaacatctttcagcgatcaaaatcccaggcaagaccagaaggggggctttcgcagctccttccgcaagctctttaaaaagaaaaatgggaacgcaactggtgaagatttctgtggtccttggggctggtggtgacatcaaagctttcctattttcagattttaggtccagtggatcagaatacagggaaaaaactaatgagaatccctcaatggatccttcacccaccaaacaagatttcttcagaaaccgacttgctcttgcaaatgaccttgaccaaggaacagctgtgtaaaacatacttaaagttgtattgtcaag

SEQ ID NO: 1517 - DNA, 594 bp, Homo sapiens
  ENST00000433605
ggccgcgcgcccatcaaggccgagcgcgccgcgcaggcgcacggcccggccgccgccgccgtcgccgcccgcggcgcatccaggaccttcttcccccaacagaggtcccaaagcgaaaaacagacctatttggaagagatgcatttagaagatactaccagattctgtcccaaagaagaaagagaaagtgaacaaacatctttcagcgatcaaaatcccaggcaagaccagaaggggggctttcgcagctccttccgcaagctctttaaaaagaaaaatgggaacgcaactggtgaagatttctgtggtccttggggctggtggtgacatcaaagctttcctattttcagggacttctgacatgagaaaactggagaaggtgcagagctggaatggattacccaagtggcttaagcaagataaaggaagaatgcaccctcgactggggactcaaatggactgatctgagttgttgactattgattggctttggtctcttttgtggtggttgagattatagtatctctgcaatctgattactgtacgaatttctgcattctaccaaatgtagcatatatgtgtggttggcttcaa

SEQ ID NO: 1518 - DNA, 456 bp, Homo sapiens
  ENST00000430382
cgccgtcgccgcccgcggcgcatccaggaccttcttcccccaacagaggtcccaaagcgaaaaacagacctatttggaagagatgcatttagaagatactaccagattctgtcccaaagaagaaagagaaagtgaacaaacatctttcagcgatcaaaatcccaggcaagaccagaaggggggctttcgcagctccttccgcaagctctttaaaaagaagggcttgtttggctggtggccccacacacccagaatgctgcttcgggatgaagctaggcatggagccagatgcagcagaaaacctgagaaagggttctcttccctctgaggctgggagggccgaaggctcatacccacaaggattcaaaagggagagtcaagttgacatcattaaaaaaatcctgaaaaatgcccaaaatatttggggaaaagaatgaccttctgattgtttccatc

SEQ ID NO: 1519 - DNA, 4300 bp, Homo sapiens
  ENST00000398800
gtgcagggaagaggaggtggcctgagccaggacgatgaggatgcaatgttgaagaataagctggagaagagaagtaaccggcactatggaaaaaaccaaaacaaagcaaggagagaatgaacatatgccggtgaataatccttccacgcagatttaccagttgcaggccctagcctccgaactcaaaactggtttcacagaagcaatgcaagaactgtcaagaattcaacatggagaatatgctttggaagaaaaggttaagagctgcagatgttccatggaagaaaaagttactgagatgaagaattcattaaactatttcaaggaagagctgagcaatgccatgtcgatgatccaagccatcacttccaaacaagaagaaatgcaacagaaaatcgagcagcttcaacaggagaagcgaagagaatctcgaaaagttaaagccaagaaaactcaaaaagaagagcacagctcacaggccgggcctgcccaagcacaaggaagtccttttcgttctatcaatatccctgagcctgttcttccaagcgaagactttaccaaccttttgccttctcaggcctacgagaaagcccaagagtccagatctgttcatgtaggagacagtaatgtaaaaggaatgatgggtcctggagtgaacccaacaactccagaagcagaagaaaacctcaagtcttgcctctcggctgatatccagtccaagggccatctcccatctggcatgtggaggcagcctaaggatggtaaagaatggggtgaagaatacgtcacaaaagaccacccagataaactcaaggaggctggccagggtagacacagctccttggaaaacgttttatgtgaaacctccttagctgctaaaagacagactgtggccctggaactgcttgaatctgaaagaaaatatgtcattaacatctctctgatcttgaagataaaagccacattccaggggtcagatggaaagaggaattccaaagagagaagcctcttccctggctctttacggtacctcgtccagcagcacctggatctgcttcacgcactgcaggaaagggtcctgaagtggccacgccaaggcgttcttggagatttattccttaagttaacaaatgacgagaataatttcttggattattatgttgcctacctaagggacctgcctgagtgcatctcattggttcatgttgtagtcctgaaagagggtgatgaagagattaaatctgacatctacacgttgttttttcacatagtccagcgcatccctgaatatctgatacatctgcagaacgtcctgaagttcacagagcaggagcaccctgactattatctactactggtgtgtgtccagcgcctccgagtatttatctcacactacaccctgctgtttcaatgcaatgaagatttgcttattcagaaacggaaaaagctcaagaagtcatccatggcgaagctgtacaaagggctggcttcccagtgtgccaatgctgggcaagatgcttcccccactgcaggtcctgaggctgtccgtgacactgggatccactcagaagagttgctgcaaccctacccttctgctcccagttctggccctgccatcacacatctgatgcccccagtgaagaaaagccaacagcagcaaagcctgatggagagcatgcagcccgggaagcccagtgactgggagctggagggcaggaagcacgagcggcccgagagccttctggcaccgacgcagttctgcgcggccgagcaggacgtgaaggcgctggccgggcccctgcaggccatcccggagatggacttcgagtcctctccggcggagccgctgggcaacgtggagcgctccctgcgcgccccggccgagctcctgcccgatgcccgcggcttcgtgcccgcggcctacgaagagttcgagtacggcggcgagatcttcgcgctgcccgcgccctacgacgaggagccgttccaggctccggccctcttcgagaactgctcgcctgcctcctccgagtccagcctggacatctgcttcctgcggcccgtcagcttcgccatggaggccgagcggccggagcacccgctgcagccgctgcccaagagcgctacgtcgccggcgggcagcagcagcgcctacaaactggaggcggcggcgcaggcgcacggcaaggccaagccgctgagccgctctctcaaagagttcccgcgtgcgccgccagccgacggcgtggccccacgcctctacagcacgcgcagcagcagcggcggccgcgcgcccatcaaggccgagcgcgccgcgcaggcgcacggcccggccgccgccgccgtcgccgcccgcggcgcatccaggaccttcttcccccaacagaggtcccaaagcgaaaaacagacctatttggaagtaaggagggagatgcatttagaagatactaccagattctgtcccaaagaagaaagagaaagtgaacaaacatctttcagcgatcaaaatcccaggcaagaccagaaggggggctttcgcagctccttccgcaagctctttaaaaagaagtccagtggatcagaatacagggaaaaaactaatgagaatccctcaatggatccttcacccaccaaacaagatttcttcagaaaccgacttgctcttgcaaatgaccttgaccaaggaacagctgtgtaaaacatacttaaagttgtattgtcaagtggtaagatgaggataaaaagcttgtatatatctgtgtaggaatatatatatatatctatatctatatatatatatatatcgatgtataaatccctgaggaaaactaatataaatacttacatatgaaactaaacatacaagacattgaagagatgaagattagtttctggttaagatctggctttttgaacctcaacactggggaaaagggaaatgaagacttttcacatcattacagaaaaacacaataaatttggaggaaaataaatgtttgtaagaatgaaaacttccaacttgaagtcattccccgagtataatactgagcatgttcatatttaacatggatttgaattttatgcttcctaggcatttaacttattaactcatccagtgttcttaaactaatatacactatgttaggggccagttctgtcttgcttcatgtcttccaaaaaccctaaggcaatatctaacatcccttaaggcaaaggattaattaacagaactgtattttatatgttgcatatctgagttatggagaatttgtgcttaaaccatgattcagaaggttcaaagcttaaaaacacattgatctccaaacttgttctgtggttatggaaatcagtaaagggaacaaggatttctgtagaaactggggagagaggaaggcaaagaaacattttcccttgtgtgggttgagctgaggatggaaacagtccagtctgtgttttattgagtactcagtattcaagacccactcgtgatcttgagtgtcacacacactcacaaccagatggactaggaaaaaagcagtgatttagccacatcttgttaaaaagactttctgcagcctgaaaagaaggtggcaatagcaccaaaacttcaatggctcacacacagcagttgctacaaacagcaggtcaaagtgaaaattcaggattgcagcacttgactgttttcctattttgtaaagaaaccaagctcttaaagcttagaggaatcagattgcaacgaggcctgcctggctctggggtgataaaatgtgctctgtttccacatggatatgtgcaagatggtcagcatccttgatatgccccaaacatcagatttataatagaaaaaaaattgggtttaaacaatttgtctttattcccaggcagttcggtatagtaaattaggggtatttggtttctgttcattcaaaatcttggtactcaaactggtgtcttcagaagctgttcctctattgaagcgtttgttgataaaataggcaaaggttcacatgtaagtgttgcaagttttcttctccttgtctgatgacaaattaggaactcacctactgcgttttgaatagtagttgtctggaacacataaaggatcactgccaagttttttgagtttccaggatctaagtttaagccaagatttttgtttcccagaagtttatgaattcatttgaaattagatttttctcttattatgtggccggcagtgcttgcaagcacaacgccaaatcgactggacgtggaaagtgaaatactacagaagtcacaatctattaaataaaatgttaac

SEQ ID NO: 1520 - DNA, 498 bp, Homo sapiens
  ENST00000505810
gttgtagcagagcctagctaattacccttcataattagaattgtcctatctactacggagtgttatagaccctctttccacaggaggggaagaaagaaagaagccggaatccccctgccatcctatgtctttgcattattgcctcactaccacatatgatcttcagaagaaaacctgaacctgctgacatggccaagcatggagccgacgagccatcctccaggtcagggagtccggacagggaaggtagggcctctgaggacagatcgctgcttcatcagaggctggctgtccgggagctcatcgacactgaggtctcctacttgcacatgctccagctctgtgcctctgacatcaggagccgcctccagcagttgccgcagggagatctggatgtcctgttctcaaacattgatgatatcatcaaagtgaacagcagattcctccatgatctgcaggagacagcctccaaggaagaggaacaagtgcagctagttg

SEQ ID NO: 1521 - DNA, 4968 bp, Homo sapiens
  ENST00000333677
agccgcgcccgccagcgccctcggtgggcacagccacccggagcggcgcgggtgccgggagctgggcgacgcgcccctcctgccccggctgcgctgttgcccgggcggccgacctccgtgcgtgagcgccggcaggcaccttgcgcgcgcggaacctgctgacatggccaagcatggagccgacgagccatcctccaggtcagggagtccggacagggaaggtagggcctctgaggacagatcgctgcttcatcagaggctggctgtccgggagctcatcgacactgaggtctcctacttgcacatgctccagctctgtgcctctgacatcaggagccgcctccagcagttgccgcagggagatctggatgtcctgttctcaaacattgatgatatcatcaaagtgaacagcagattcctccatgatctgcaggagacagcctccaaggaagaggaacaagtgcagctagttggtaacatatttctggaattccaagaggagttggagcaagtctataaggtctactgtgccagctacgaccaggccttgctactggtggacacgtaccggaaggagccggagctgcagcggcacatccagggcatcgttgaggcggtggtgccgcaagctggatcttcaggcctcagtttcttgctggtaattcctctgcagaggatcaccaggtacccactgctgctgcagaaaatcctggagaacacagtccctgatgccagtgcctatcctgtccttcagagggctgtctctgccctccaggacgtgaacaccaatatcaatgagtacaagatgcgcaaggaagtggcctccaagtacaccaaggtagagcagctgaccctccgggagcggctggcccgcatcaacacacacaccctctccaagaagaccacccggctgagccagctgctgaagcaggaggcggggctgatccccaggacagaagacaaggaatttgatgatttagaagagaggttccagtgggtgtctctgtgtgtgactgagctgaagaacaacgtggctgcttacctggacaatctgcaggctttcctctacttcaggccgcacgaatacaatctggacatccccgaggggcctgcagtgcagtattgcaatttggcaagagaccttcaccttgaggccttcctgaaatttaagcaacggctagaaggcctggtgtggcagccactgtgcagcctggccaaagccctgcttggccctcagaacctgatcaagaagcgtctggacaagctactggactttgagcgggtggaagagaagctgctggaggtgggcagtgtgacctaccaggaggaggccgcccggcacacataccaggcactcaactcgctgctagtggctgagctcccacagtttaaccagctggtcatgcagtggctgggccagatcatgtgcacattcgtgaccctccagagggaccttgcaaagcaagtgctgcagagggcagagggaagcatggcccagctgccccaccaccacgtcccagagcctgccttcaggaagctggtggaggacgcactgggccggacgagtaaccagcttcgctcctttcaagagacctttgagaaagtgcagccacctcccaccacacaaccgctccttccagggtctgaacgccaggtgcaggctctcctgagcaggtatggccctgggaagctgtaccaggtgacaagcaacatcagtgggactgggactctggacctgactctgcctcggggccaaatcgtggccatccttcaaaacaaggacaccaaaggcaacagcggccgctggctggtggacaccgggggacatcgtgggtatgtgccggctgggaaactacagctgtaccatgtggtccccagtgcagaggagctcagaaggcaggcggggctgaacaaagacccccgatgtctaacaccggagcccagcccagctctagtgccctctattcccaccatgaaccaggtcatagccgcgtacccttttgtggccagaagcagccatgaagtgagcctgcaggcaggccagcctgtgaccatcctggaggcccaggacaagaaggggaaccctgagtggagcctggtggaagtgaatggacagaggggttatgtgccttctggcttcttggccagggctcggagcccagttctgtggggctggagtctgccctcttagggtaccctctttggagcctacattgccaaatgatgggggaggcttagaggctctgaccctggggggaaaagaagcaaaggaaaggtggaggtggaagggaagaccaggccagggtgggtgaagcacactcaggaggcagccagaagacatgggcgggcctcgcagagtgcttggtgtggtgggggcacaggaggctccagccaggactgctcattatgtctgcataaagaactcattccgacctggggtcacaatgcacttggacagcaggtcacagctgattggccaggactctccataggttatggccagtcttagctgtgcctgcatccgggcctgcctgtgggcgtgggtcacacgggataatgttacctgcgtgctgtgtggttgcaggaagcgggttctggaggagtccagaactgcctggtcagacagttcacttcctacacatggtatcaggagacatcataaccaatgagtcagcttttatttctctatgctggaagctgagtttatcttgggcagtgacccactgggagccctctcaagtggggaagccatggatttatcggtgtagcagagaggttcccaagactcttgactggtcctgggagtgggtgtgaccaagtcatagttctggaatgtgtgtaggcaaattcagaggctgttccagggaagaggggattttgatactgtgttaggtggggtgtgtgaggctgttggcagcaggtgaacagctactgctgtgttctcaggactagggaacaaaggggtatgcaaatcatagaggaaactctgggaaggcggtgataaggcctggtgggtggggaggttagggaatggcttgctttcctgtttctggttagaaggggagccagggggaacccccagtggtttcaggtggcccctgaggtcctggaggcagccgtggatgtgatgcaattggctgtgggaccttagatgtaggacacaacttcagtgttcccatccagaaagacctcactcacagggttgtgctgagaatgacgtggggctaagcatgcagagctccctgtaaactgtgaagtgtgatacaaatgtaaatgacagcagtgatctcggggtggcccccggcatgctgccctcccccacgcccatgcctgtggcagcaaaccttgttcatcagtatagctttctttcctgtaacccaggatctaccttggggggcttctcaatactgcattctatgtagccagcctctttaacttggtaagtgagccaccccattctagaacctggaaattggagcccctcaaaaacagttcctgttcaaggaggactgacctgctggggcaatgttgggtgcagtgcagtccctgcttggggtggtcatgtctaggctgttgctctgggcaaagataagttgcaagattcacagaaatgggaaaatgtgaccaagtgtgatcttaacaactgacaaagtttgtaaccaacccaagttagaatgtgtgtcaaacaggaggtagtttagatatgcttccaagaacatgtctgtgttataaccatagtgcctaagcagtgagctctggtttttgaagggcttttaagaaatatatacatgtctgtgtcagtctataacttgcctcctctgggcctgttaaagcatgaagactgcatgacacaagagaaatgcaagccctacggttcctttctcagcagcgaattcacttgagaggatgctcttgactcattctctctgctctttcctgctcagatttctgataaaaatagagagcataggggaacagataatgaaataggaaacccactcgtgggttccacagatacctaccgaaggcctactgtgtgctagaattgtagctcaggagttctcagtgtagctgctcactgaagttaccatggcaggtttcaactggcagaatccaggctccgtcccacccagagattctgatgaaattggtttagggtgtggctcgggcctcaggaattcagaaagcttcccaggtgcttccaatgtgcagccagggttagggacctctaccctagacacaaagtattggacagatagacctggtgccagagatggccatgagctgtaagctaggacgtgccccacctgagctctgcactagctagttcaaacaggcgctttaaaggcagtgtgaaaggggacagcctgttctgccaggtctcagaatgtatatttattaagtgccattaaaagggacctgaacaaaattggatgtcttgtaggcataagggaggaaaataaaatatacttggaaccaagtctatgtcatgaagggaaaataaaaatgtattcagtagcacgtgggttatggtttctcatagaccaggggataagattaaaagtcactgaagagtgggaaaatgcatgttgagaagatgagaatggcctgtattttctccaggggaatctgtgtaatgtgccttttccctctccaaatgcctagaaccatggcactgtgtcttatttatttaaccgttgggctgtctcatactaaacttgcaaagatatttgcctatgaactgaacaagacttccaggagttgaagtctggttcacaagggtaccccttgcctcctgtgatggagtgagaactcttaaacccctcaggccccaactcagttgtggagatgaggacaagattacaatatcaaaagaaagatgaatgaattcttggttaatatgacgaaccccagctcaatgagtaactgatgtgaactgctgggaataaaggacttcaaagatggaaa

SEQ ID NO: 1522 - DNA, 588 bp, Homo sapiens
  ENST00000509831
tgctaagagccagccatctgctagtgagggccctgttgccctgatcagggtgggcccttcagtggcagagttaggatcaggcccagtactcctggctgtcaaaatgtgagcaaatgttggtgccagctttgacaggtttattcaagcacttgtgtctgtctgtgctcctcctctcccagccgctccttccagggtctgaacgccaggtgcaggctctcctgagcaggtatggccctgggaagctgtaccaggtgacaagcaacatcagtgggactgggactctggacctgactctgcctcggggccaaatcgtggccatccttcaaaacaaggacaccaaaggcaacagcggccgctggctggtggacaccgggggacatcgtgggtatgtgccggctgggaaactacagctgtaccatgtggtccccagtgcagaggagctcagaaggcaggcggggctgaacaaagacccccgatgtctaacaccggagcccagcccagctctagtgccctctattcccaccatgaaccaggtcatagccgcgtacccttttgtggccagaagcagccatgaagtgagcctgcagg

SEQ ID NO: 1523 - DNA, 5489 bp, Homo sapiens
  ENST00000409359
agtgctgcggccgggctccgggcgtcccggcggccaccatgctcagcgtcgtgcacttcctccggagcttcttcaagactccagagccaggtgcacacctgccaggtgaaggtgagattgaagataaccagctccccacatcccctgcagaacaagtggagcagggatggaaccagcaaacagaccgcgatgattctgaaacgctgtcccagcagagtgaaagtggatcagacacaaaaactgacccctttgaaagtgcctctgacacagagtccttgtctgggtacctcccgaggggagtcttccaccctctaagaggtactcccgtagatatagaagcaccttgggaataccctgatgtctcagcaactggaccccctcaggagcagcatttgaccagtgttcctgggcttcatgcaaaggaagaactcgatttgtcccctagcttagaggatgactcttgcaaaaatgggtggcgagcctttgccacagttgctggagaacaggaggcaggacacctctgggactgcgcgaccagcctggagcgagagtctttgctggcaggggttccccgacacacagggtgctgcttacagagggccacagacagcagtggtcctgagccagtacagggggtggctgttcaagacctcagagggctctccagtgtttctcttcagaaatccaggtctgagagctatctgggcatcccagtggtctggcccttccttctctggtgctgtgaactgggtcggagttggccacatatccacaacagggccagggcactggtgctacctagcagaggcccactggacaacacagcccctctggggaccaggacaaagaaggaaagtactctaggccctgcaggggacacagaattgctctggtcccagccccactcggatgtcccctgccagcctcctttgaggacatcttgcctcctacgcaccaaccgtcaccatagtgccccagaaactactggtgacaagaacagggcatcccccagactcaactgtgggcacatgagggcactggtcagggcccattccatagcagggttttcaccagagtgccccgaggatcccgtgggacagaatgttgtgaagtctgggacccatgtgaaggaaggggccaaaaatgaacgagatccaagaatacaaaacatcccttcccctgcacccacccagctgtctggcccgattcctgcttttcagagtggggctccccatctgcagggtccctgcaagcctggtgggtttcgcttgcaaagggcctctcaggacactccttctgcaggtctcctgggggaaaaccagttaagacaggattccaggtcatgtctggtggcttcatgcctcacctcagagttagtgaagctcagtgcagaggaagtgcctgagcccgctgagtgcaagtcagagcaaagcccagaaagcagaacccaggaaccccaaggcacccaactcgcaccaagagctgctgatgagagagagacacagaagcacctctggggcatttctgtccaggcaggaaaccaaaccagtaattacacatcaaagtatgtgctcagcgaggaaagcaagtcacctaccagggccaagttcccacggcagcctagcagtgaggggacccaggtgtggagtggagacttgatgggctgcttggaagtgagtgacagttcagatgcccctgagaccacccagaaatcaagcgcaatagacacttcaaaggcagccgaagaagccatggttctagaccccaactacagggaacaggctttgcaaggtctttcagaattcaaggcagccacggtgtctcactgcggccccggggctgaggagggtgaacaggggcctgggggtgccgggggccggcagctggagcccaaagcaggcggcgaggcctcgaggggcaggggcgccctcatcattgtagctgtggagcagaaaggtcttcaggccagcaggagcaatgcggggcctgttccagaaacactgccccgtgactttcctaaggaaagaccagaatctcccttgagcactggcgagaccccctgtgagtctcccactagggggaaaacaccagccggtaatgagtgtgagttgccagcagcccccatacagggagctggcgatggggctcttcagcgggtggcccaggccgcagagcttgggagagtgctggtcccccaagctgcttcggaagagacgccgagcacagaggagcccccgggagagagactgcgtggggagagccggagctccgggtcaggggagcgtggcccggaggaggcccccgaaggcggtgctgcagcagcccggggccagcgcccccgcgtccccgccttggagccgccccagccgccacgcgggctccgcaagggcgcgcaggagcctgggaagcgcccgacgttttccaaggtgacctccttcaggaagggcaggcccttggccactgagagcccaggaggggtcccggccccgaccaccgagggtcgccgctggggctcttcaggccccgaggggctccccagggagaatccgcccgctgcggccggtcgggacgcaccgcctctgcaccacggggacgccagcgcctggcccgagtttgtcccgcaggctgcaggcgacaggactgcagggccggcaggagcggggcacacggggacctcaggggatcttggtagccgagggccttcctctgagagctgcaacgcaaagagactcaaaacaacggagaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcggtaggtacctaccttcaggtatctttccggaaaagtcctggctggcgtcccccggcagccctcgggcccagcaggctggaatcgcacacaccctgccttccagctctgcctgctgcctggcatatgaaaaccccgggacgccctgcagacccacgagccccaagcccctgagtcccaggcctagtgctcagcggatgggtctccactaccccgggaggggtagcgccatctccatggtttctcttggaagctacagctacgtggacagcagttcaggggaccctgaaagacccaagattcccaagggccagaccagtttcctgctttctctgcagacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtga

SEQ ID NO: 1524 - DNA, 4788 bp, Homo sapiens
  ENST00000526381
attccccaggctgagagtacgcgagggcgcagcagcggcaaggggctggaactggggtcggggctgttgggctcctgctcggggtgccccctctctggcccgatttccgggcccgctcaccatccgggacccactcagttgggacgcctccacctcgctgcccccacaggaaccccaagatgggccgggggctccggggcactgtcaggggtggccggccacaggttgccaagcccgacctccccagactccagagccaggtgcacacctgccaggtgaaggtgagattgaagataaccagctccccacatcccctgcagaacaagtggagcagggatggaaccagcaaacagaccgcgatgattctgaaacgctgtcccagcagagtgaaagtggatcagacacaaaaactgacccctttgaaagtgcctctgacacagagtccttgtctgggtacctcccgaggggagtcttccaccctctaagaggtactcccgtagatatagaagcaccttgggaataccctgatgtctcagcaactggaccccctcaggagcagcatttgaccagtgttcctgggcttcatgcaaaggaagaactcgatttgtcccctagcttagaggatgactcttgcaaaaatgggtggcgagcctttgccacagttgctggagaacaggaggcaggacacctctgggactgcgcgaccagcctggagcgagagtctttgctggcaggggttccccgacacacagggtgctgcttacagagggccacagacagcagtggtcctgagccagtacagggggtggctgttcaagacctcagagggctctccagtgtttctcttcagaaatccaggtctgagagctatctgggcatcccagtggtctggcccttccttctctggtgctgtgaactgggtcggagttggccacatatccacaacagggccagggcactggtgctacctagcagaggcccactggacaacacagcccctctggggaccaggacaaagaaggaaagtactctaggccctgcaggggacacagaattgctctggtcccagccccactcggatgtcccctgccagcctcctttgaggacatcttgcctcctacgcaccaaccgtcaccatagtgccccagaaactactggtgacaagaacagggcatcccccagactcaactgtgggcacatgagggcactggtcagggcccattccatagcagggttttcaccagagtgccccgaggatcccgtgggacagaatgttgtgaagtctgggacccatgtgaaggaaggggccaaaaatgaacgagatccaagaatacaaaacatcccttcccctgcacccacccagctgtctggcccgattcctgcttttcagagtggggctccccatctgcagggtccctgcaagcctggtgggtttcgcttgcaaagggcctctcaggacactccttctgcaggtctcctgggggaaaaccagttaagacaggattccaggtcatgtctggtggcttcatgcctcacctcagagttagtgaagctcagtgcagaggaagtgcctgagcccgctgagtgcaagtcagagcaaagcccagaaagcagaacccaggaaccccaaggcacccaactcgcaccaagagctgctgatgagagagagacacagaagcacctctggggcatttctgtccaggcaggaaaccaaaccagtaattacacatcaaagtatgtgctcagcgaggaaagcaagtcacctaccagggccaagttcccacggcagcctagcagtgaggggacccaggtgtggagtggagacttgatgggctgcttggaagtgagtgacagttcagatgcccctgagaccacccagaaatcaagcgcaatagacacttcaaaggcagccgaagaagccatggttctagaccccaactacagggaacaggctttgcaaggtctttcagaattcaaggcagccacggtgtctcactgcggccccggggctgaggagggtgaacaggggcctgggggtgccgggggccggcagctggagcccaaagcaggcggcgaggcctcgaggggcaggggcgccctcatcattgtagctgtggagcagaaaggtcttcaggccagcaggagcaatgcggggcctgttccagaaacactgccccgtgactttcctaaggaaagaccagaatctcccttgagcactggcgagaccccctgtgagtctcccactagggggaaaacaccagccggtaatgagtgtgagttgccagcagcccccatacagggagctggcgatggggctcttcagcgggtggcccaggccgcagagcttgggagagtgctggtcccccaagctgcttcggaagagacgccgagcacagaggagcccccgggagagagactgcgtggggagagccggagctccgggtcaggggagcgtggcccggaggaggcccccgaaggcggtgctgcagcagcccggggccagcgcccccgcgtccccgccttggagccgccccagccgccacgcgggctccgcaagggcgcgcaggagcctgggaagcgcccgacgttttccaaggtgacctccttcaggaagggcaggcccttggccactgagagcccaggaggggtcccggccccgaccaccgagggtcgccgctggggctcttcaggccccgaggggctccccagggagaatccgcccgctgcggccggtcgggacgcaccgcctctgcaccacggggacgccagcgcctggcccgagtttgtcccgcaggctgcaggcgacaggactgcagggccggcaggagcggggcacacggggacctcaggggatcttggtagccgagggccttcctctgagagctgcaacgcaaagagactcaaaacaacggagaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcggtaggtacctaccttcaggtatctttccggaaaagtcctggctggcgtcccccggcagccctcgggcccagcaggctggaatcgcacacaccctgccttccagctctgcctgctgcctggcatatgaaaaccccgggacgccctgcagacccacgagccccaagcccctgagtcccaggcctagtgctcagcggatgggtctccactaccccgggaggggtagcgccatctccatggtttctcttggaagctacagctacgtggacagcagttcaggggaccctgaaagacccaagattcccaagggccagaccagtttcctgctttctctgcagacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactggtgagttacgcgcctctctcttttgctatgtactctggatcctggcatgaaggacaagaagctagtgctgttggcagctgtatccacttgcctggtagaagtagcttgaaggtgagagagataaacaattgtcctcttccttcagttagggaggagtgcctactacccaaagaaagggaattattggctgggcacagtggctcatgcctgtaatcccagcactttgagaggctgaagcaggcggatcacttgaggtcaggagctcaagaccagcctgggcaacatggtgaaaccccatctctactaaaaatacaggccgggtgcggtggctcatgctataatcccagcactttgggaggccaaggtgggcggatcatatgaggtcgggagttcgagaccagcctgaccagcatggagaaaccccatctctactaaaaatacaaaattagctgggcatggtggcacatgcctgtaatctcagctactcgggaggctgaggcaggagaattgcttgaacctgggagtcagaggttgcggtgagccaagatcacgccattgcactccagcctgggcaataagagcaaaactccgtctc

SEQ ID NO: 1525 - DNA, 3656 bp, Homo sapiens
  ENST00000636987
agaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcgacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaa

SEQ ID NO: 1526 - DNA, 1638 bp, Homo sapiens
  ENST00000438985
ccacttgcctccacacctttgtcctccagtttagtttctccagaacacaggaggaaaagtgaaccgaccatcaagtgcacagccacccaggaaggcggtaggtacctaccttcaggtatctttccggaaaagtcctggctggcgtcccccggcagccctcgggcccagcaggctggaatcgcacacaccctgccttccagctctgcctgctgcctggcatatgaaaaccccgggacgccctgcagacccacgagccccaagcccctgagtcccaggcctagtgctcagcggatgggtctccactaccccgggaggggtagcgccatctccatggtttctcttggaagctacagctacgtggacagcagttcaggggaccctgaaagacccaagattcccaagggccagaccagtttcctgctttctctgcagacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaat

SEQ ID NO: 1527 - DNA, 3800 bp, Homo sapiens
  ENST00000392953
gggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaaggtaggcggacagcagccccacctcctcggctgcccggtccttaccctgctgacatcattcccttctctgaaccacaaagccaagccagctagccaccaggcctgaggggggcccactgccctttgcagctgtttgttcccaaaggttggtaataaggggccactggggaagcctgggtcagtatatggttgacattcttactctcaacaccttggctcccccagatcagggccattggtgacaatgcttgtttccccagggttccttcctgacaggcatctggggttggtgtagggatggagctgctttccccatttctacagagagccatgcccctgaaacatcacatgcctttgcacaggccacccccctcttcaggctgctgcaggaggccaggcccaggccagagaccccaggcagcctgagctcttggatgtggtcagctctccaggagcaagtcctgtgtggcaaaactgcctcctacggcggctctgaagcagagccctgggacggaccccatgctgtccccaacagctggggtggcactctgccctgggcacccatgaccctctgctgtctctccctgttcagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagt

SEQ ID NO: 1528 - DNA, 2102 bp, Homo sapiens
  ENST00000409303
gctccaggcctgcgtgcgcgcgtgcgtgagcgcgtgccgaccgggcccgcgacccgcactggggtcgccgttgaggctcagcgcccgccgggcggccggtagtgggcagcgagctgacgcgctgcgctctgccgggagggcgcctggcctcgctccgagccgcgcgcgccccgcgcctgccaagggtcccagctgccgcggccacagagcccgagcggggggtcggctgagagcctccttaacggagccccatgatgtcagccggcccgcacgcccctcgccctccgactgcgaccccggcccgggctcgcgcgccccgtcccccggcagccccgcggccgccgcaccgccgcccccggcccagccttccccgagcctgtggctggagctcgggcccgcctgcgtgcgggcgcagcaatgccccagcgagtcaagcgggcagacgagtggcgatctcggcactagcagcagcagcagcgccgggctgtccccgggctccgactcggacagcagcggcgtggtgtgtggcggccgcggaggcaacgggggcatgcgcggcgccgtgtcccgctcctggagcctggagagcctgcgctcggccaccgccgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaag

SEQ ID NO: 1529 - DNA, 1872 bp, Homo sapiens
  ENST00000355771
tagagagaggaaatgaggccagatgggcagcaagctttggatgctgtggtaaggagttttgactgtcactctgaagcagctctcaggcagaggaatgatgtgatttattgtagtttaccaaggaccgctcagggtattgtgcagagggaagaccagctggaggttcttgtgtcactccgtgaagtgtgggggcggcggaggggcagagatgggacctgcactggagccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtga

SEQ ID NO: 1530 - DNA, 840 bp, Homo sapiens
  ENST00000496764
agggcttggggcctgggaggcgccgcgcgcacggcgccggcttcgcgggaggagccccaggcccgcgagcgcaggcgccccgcctctccccgggcgctgcgggccaccggctcggccctgtgcggcgggatctcggggccgcacggagcgggaggccgggcgccatggcgagggccccgcagccccggcgcggccccgcggcgcccgggaacgccctgcgcgccctgctgcgctgcaacctgccccccggcgcccagcgcgtggtggtctccgccgtgctggcgctcctggttctcatcaacgtcgtactgatcttcctgctggccttccgctgagcggccgcgcagggcgccgcgccgggctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggccccgggagtgggaaccatgacttacacctgaagaagttgaggcacggtcaagttattagccctggagatagcagagaggggacctggattccatctaagggggtctccagtcttcaaggaaggaatccaggtgcagtctccaaaaggcctggctcagggcgtccaagctgagggccgtccggcggggaggtcccaggccctggtgttcagatgctcctcctgccccagatcccctgggaaactgtccactccgcaccctaagcctttccccaagttgcatgttagccagcgggcgcgc

SEQ ID NO: 1531 - DNA, 901 bp, Homo sapiens
  ENST00000439368
gcgggaggagccccaggcccgcgagcgcaggcgccccgcctctccccgggcgctgcgggccaccggctcggccctgtgcggcgggatctcggggccgcacggagcgggaggccgggcgccatggcgagggccccgcagccccggcgcggccccgcggcgcccgggaacgccctgcgcgccctgctgcgctgcaacctgccccccggcgcccagcgcgtggtggtctccgccgtgctggcgctcctggttctcatcaacgtcgtactgatcttcctgctggccttccgctgagcggccgcgcagggcgccgcgccgggctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaa

SEQ ID NO: 1532 - DNA, 662 bp, Homo sapiens
  ENST00000528247
gggctgcgggggcgaggggggaggccaaaatggcgcgtctctgcgagtaaccgaggatgcggattcagctggggctccccggctgcttgtctggaaacggagtgcatgtgaccgctgggtgagcgacccgcgcttgcatctgtgtaggttgagtcagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacc

SEQ ID NO: 1533 - DNA, 3229 bp, Homo sapiens
  ENST00000490728
gggcgtccaagctgagggccgtccggcggggaggtcccaggccctggtgttcagatgctcctcctgccccagatcccctgggaaactgtccactccgcaccctaagcctttccccaagttgcatgttagccagcgggcgcgccacccatccccctgcttctgcccgctggggctggcaggagcaggcactggttcaggaactgcagcaagcgctccagcctctgtgccgggcacaagcagggtctaggaaggaggccaaatcggtattcggatcacactgacggcggctgcgggcgtcggagtcgtcattcctcggtccaggacttgcgtgggtggcgtggtggggggagctggccggccagtcctcagccctgcgccccgtacaccctgcggggcctccgaggcccggttcccgccgctgcggcgcagggcgcggggcgttgctccgagggatgcggggcactgaccggccacgcatggcctgcagctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacaggtaggagggcactgaggcagggaggcagcccacgcctctgcatgcctccagtcagccagtttgagcattagcagtgtgctgggcactgctgcagccctggggcaacacacagaaaactagccctgtcctgatgagctccttgcaatgggggaagaggatgccaacaggatattaagctctgctctgtgcttgccatttatggagaagagaggggctgtgcatctgatagtgaggatgtggtcaaagggcacagccccagaggaaagcagctccacacgtgggggctgcaggggatcctcaccctttctctgtctccagcctgcagcagccttccatctctgttctgccccagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaa

SEQ ID NO: 1534 - DNA, 882 bp, Homo sapiens
  ENST00000532720
cgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaaggtaggcggacagcagccccacctcctcggctgcccggtccttaccctgctgacatcattcccttctctgaaccacaaagccaagccagctagccaccaggcctgaggggggc

SEQ ID NO: 1535 - DNA, 499 bp, Homo sapiens
  ENST00000527365
caagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggtaccagagctgctctgccctgctgccccaagttgagcaagtggagggaggggagctgagggctgggagcagctgcccagaagacag

SEQ ID NO: 1536 - DNA, 769 bp, Homo sapiens
  ENST00000525092
cagtcagccagtttgagcattagcagtgtgctgggcactgctgcagccctggggcaacacacagaaaactagccctgtcctgatgagctccttgcaatgggggaagaggatgccaacaggatattaagctctgctctgtgcttgccatttatggagaagagaggggctgtgcatctgatagtgaggatgtggtcaaagggcacagccccagaggaaagcagctccacacgtgggggctgcaggggatcctcaccctttctctgtctccagcctgcagcagccttccatctctgttctgccccagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggacca

SEQ ID NO: 1537 - DNA, 3666 bp, Homo sapiens
  ENST00000326016
agaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcgacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 1538 - DNA, 3828 bp, Homo sapiens
  ENST00000525839
acgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaaggtaggcggacagcagccccacctcctcggctgcccggtccttaccctgctgacatcattcccttctctgaaccacaaagccaagccagctagccaccaggcctgaggggggcccactgccctttgcagctgtttgttcccaaaggttggtaataaggggccactggggaagcctgggtcagtatatggttgacattcttactctcaacaccttggctcccccagatcagggccattggtgacaatgcttgtttccccagggttccttcctgacaggcatctggggttggtgtagggatggagctgctttccccatttctacagagagccatgcccctgaaacatcacatgcctttgcacaggccacccccctcttcaggctgctgcaggaggccaggcccaggccagagaccccaggcagcctgagctcttggatgtggtcagctctccaggagcaagtcctgtgtggcaaaactgcctcctacggcggctctgaagcagagccctgggacggaccccatgctgtccccaacagctggggtggcactctgccctgggcacccatgaccctctgctgtctctccctgttcagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatg

SEQ ID NO: 1539 - DNA, 3486 bp, Homo sapiens
  ENST00000611048
agaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcgacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 1540 - DNA, 2172 bp, Homo sapiens
  ENST00000428230
agaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcgacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 1541 - DNA, 4764 bp, Homo sapiens
  ENST00000370620
agtttcgccctggtggcggccgcgctcagggcagggtcccagctccggctgggttgatctgttcccgcagccttggcacaggcttgcccgcccgctcgccggccccgtgactcgggagggcgaacggcttccaggaggcggcggcggcgcggctggagtgagggagcagctggaggacaggcgggcagcggccgagccagatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaataa

SEQ ID NO: 1542 - DNA, 4779 bp, Homo sapiens
  ENST00000370622
gccctgaccctgccacttgtgtgaagtcaggatctcctttcccaggcctcagttgagtcatctgtaaaatgaggagactagagtaggggttgggtaatgtctaatggttgtaatgtctgtttttaacttgcccatttccatcagtttccgctaggcaaagctttgcatatttagctgctcagttggaactagtaggaagaccaaagaggattttgatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaataa

SEQ ID NO: 1543 - DNA, 6019 bp, Homo sapiens
  ENST00000250617
attaaagttggccttatcataaatttcccaatagtatgcctatttcaagtggttctgaaaatgtttgagaatgatgaagatctcttgttatagacagtttttttttcagagcagtattttaagtgcaaagtgtttttttgttgttgttgttgttgggaaaataagaatcttccatattgtagtgtagacagaggacaagtgctcttttgttctcaaacattctattttttcaagtgtattttacccacttatgtgactgagtctgagcctttgctaagggtactgcagctggattatgtagtggaaccaggtccagaaaaagaattgctaaagaatgcaagtaaacaggatgtcagatgttatccttagcctatttccctaaacatagctttttggctgcaaagtaaaatgccattcttctagcttctgcttatacacagtgatggctgacagcaggcataatcttcgtttgcttggcacgttgtcaccatgcaactcaacgtgttttgcaaggaatgatcgtgacacaccatctctgggagatactatgaggacatccggctatttcttggaagaattttctgtctaccttctttgagccctgttgtgccagcacatctccccatgaggctcagatctgtctgacctaagagccagttggcatcgtcctcctaacagaagccagattttcactggggctagactatttattgacagtgttttcccagactggcccatgagtgtctcatttccaaggtcccctgaagtgctggctcacctctgtttcccaaagcacttgcttgcttgtctctcctccctccccagcatccttttcactttcttcccttataacttcttgcactctgtgtgcgtgtgtgtgtatgcgtgtgtgcatgtgcgtttcttctttttttttatcctaacgaatttgttttgcaggttttgaaaaggaaaaaccagcgttatccaggattgttaaattaattcttatctgtttccacatcttggaccgtgatctctgtggttttaaaatcccatattttgagtgggttccgctgttgtttaagaaaagttgctttaaacctttgctctgcaagcacccgaagagaactcataaaaaggaagacaacagcagatgcaatcgcggatgtggcttagtccttgcagctgccccagagtgctgtttggagtgtaccgtcctcagtaatgaatccagaagaacaaatcgtgacatggcttatatctttgggagttttagagtcccctaaaaagaccatctgtgatccggaggagtttttaaagtcctcgctgaaaaatggggtagttctgtgcaaactgatcaacagactcatgcctggctctgtggaaaagttttgtctggatccccaaactgaagctgactgcatcaacaacatcaatgacttcctgaaaggatgtgcaaccctccaagtggaaatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaataa

SEQ ID NO: 1544 - DNA, 21681 bp, Homo sapiens
  ENST00000379887
gctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttgttattccattagttacttatgtttatttttatagttaaaaaatgactaaaggtggctaatagccacccgtattatgtgccttattcactgttcccacttaatataaaatgtcaaaaattggttgtttctttgcagggaactgtgaatgagcccattcccccaacatttaacttggttaatgaagctttcagagcattttctgaaagatttccaatttctgcatctcagatattgaatttaaattgtttgtgttgtaacagtgatacaaaaatgttcaatagctctttgaatgccactttttttaaagaaaatactttaaaagtcattcttagctaacctcaaaactcctttacattactttcattttagctcactcttaaagctgatactgttatatagggatgaagggagagttttcttaaagaaggtcccaaagttgaagatcgtttgtcattgatactctggccaagtccaggttttaggacaatttaatttactcttatttggatctgtaattatgggagtttatcacttttcctcttcaaagcacttcaacttactgtctaaaacaagtggagaagaaattgccattttttataaaggaggaagataaggctcactgaggttaaataactccctcaatttttcatttccttctacctgaaacttaacatcatgctacctctttgtatcatattttgttattctggtcacagaatgacctagtattctgtaccagggaaggtagttcttaactatattgtacttttaaaccacattaaagactattataaatgcctatcactgctactgttagaggttgctctatactatctctgatctttcatttgttgcagtttgcaacacagtagttgagaataagtggtttagtatgatttgcttaatagtacccaagtaatttgcagttgttggtttagttattcaaatgaatttccattgtaaagaattttggatagtctgcaggaaattgttacaggatgcacagaacatcccatatccattggatctcagcctttgaggctttaaaaagatgataagcagtgagttttatgagaaaattttggctccttcagaaacaggaagataagtgggcccctcagatttttcatatatctttggggataaagttggttatatctggtttattttagggattttgcttctgtagttacccaagatcaaatagccaactcagaaatactcagttggatatcaatcaaatagtgcctaccaggggagtaaacagacaacttttaggtttttagtttttgcttttgtgtggagttgagtccaatttttaaggcaactattgttgacctttctctaggcggtagcatttaggatgggaaaaaataatatgagttatgtgcgaaaagcagttttcaggctatcatttagggccacagatatgcttatttaggactattttcagggtaggagccagttaaagtttgtatatcagtcacacattgatatgtagcagctctatcaataccacaacaaccttattaccatagtaattcaggggtctcaagtaatccaggagtctcaaactgaaatgtcaacaagagccaagtaaatattttagaaatagagtaccctggagtagatgggctctgagaggagcctgtgaaatccagacttcatgtgaattctcttaattaaatgtgggccaaagaaaacccggccatgggcagtttttttttcccagcttctactagtcttggcttgcaacaatgccactgtccatctggcattacctagaccagtgatacttaaacttgactgcgaattggaatcactgagaagctttaaaaaatattagtgcctgagtgttactttatggagattatgatttaattgctttgggtaggcatcagtaatttttgtaaagccctttacgcattctcacccctaattccagccggtgattctcacatgcagactaggttgagatccttgatctagactgccttctatagttgcaaaaagagaatataggcgagcaactccagatcataagggacaaaatgattcaaggcaaattgactggctcagaatagggcctcactggaggccctagttgagtgggttttgtggaatggtgcctcccaagggtctggtgtgcagtgcccaatttggttttttgttggttttctggtaagtggtccaccttggagaaaatcacaaaactaaaagtcttaccaagaagtagaactgacaagcagccatgttgattggcagtacattctcttaccaagggggagaaatctatctagggaaaataatacagagtctgagcaaaggaagttgagtggttataagcaaaactgtcattaaagctagttgcgtcaagtctgcacaattccacgagcacttaagagtttacaagtttctcatgtctatcattcttttgataatcttgtatttttatttcaagtgtggtatagtagtaagaatattggtatttctcagccatagatttcccttttgtaaaatgggaatactaataggaactgtaatttgttgagtgctttttgccagatgccttacttttgtctgtatcttccaagcagccctaaagcaaaatgggcattgttaccctatttttatgaggaaagacactcatatactactaacttactcaaaagttacacattgagtgtataacagggccatgcttgtctgattccatatgttcattctattatgctgctgttgtctgttacataggaatattgtgaggatcaaagaacatgtgaaaacaaaacctagttacaataataagcacaccagtgctaacttgggcaaaagataaggatacagagctgtctcagagactcccaaaggcaggatgagattgggaactagaaaaccattttggacccctaaagtggtattgtctactatctgtacatcattctcttacagctcttactgctgcttttcctgtcagttaccccatagctccaggtattacatgttaactgttcctgacacatgtagacagaaccaatcagatccatggggcaggatcatcaatacaaacatgggtgttgagagcttaacttaatcgggaaggagatcttggagatcatagttcgctgggttcacatcatggaaatcgtctttgacaaaactgaaatgccctgaagttttaattttttaaatacatgtaatgaattggtatatggtagatactcgtggctacttagtatttaccaaatgctttgtttccatctcgtttatttttattttttatttttttaagagacagtcttgctatgttgcccaggctggacttgaactcctagtctcagccaaccccttctgcctcagcctcctgagtagctgggatcataggcatgtgccactgctcctagctcttccatctcagtcttatgatgtagttactattttcattttataaataagaaaatagaagctcaaataaaatgggtagtttccttgaggtcatcctgttagtaagtggtggaatgaagttacaaacctaggttttattggtcagcacacacagtgccgggcactggcagtacagcagtgaacaaaaggtctgttggtttgtctgaagctctcaaccttgattctgcatagactcggtggattgcccaaggccactcaaccagttaatatcagagccagctctgctgtttgaccagtatattattttcaccatgctgtatctgcttctcagtcaccaaaagcaccagctaaaattgtatatagactgattaggggacttccaacctaagattgtcctggaaacttaattcttatcttggctcatctcttcaaaacagatgcctctttcgttggtgacctcagatacactgttcagaagtactcaaagtattccttttttctcacatttgagagtcactctagcattttaatgagttaagcaagccagccctgcatttccaaacccttcccagaagtctaaccttactttgatctgatgacatgggctttttaaaagattactatttttttagaggtggggtctcactatgttgcccaggctggaatataatggctattcacaggcacagttagggtgcactactgccgtgaactccaggactcaagccatcttcctgccacagcctcctgagtaacctaggactataggtgcatgccaccatgcccagctgacaatggctttatatacataatatttcctcagcaacaatttatgtcttatttggcacctgtaaaaccctcttcactgattatgcctgtttaaaggtttggtatttactccaagtcacctgcctttagccatggagtattcaagtttctttcagaatgagaatttggagggtgctcatagaaatataaaacaaggctgggcatggcggcttacaccttgtaatcccagcactttaggaggctgaggcaggtggatcacgaggtcgggagttcgagaccagcctggccaacacagtgaaacctcatctctactaaaaatacaaaaattagccaggcatggtggtgcatgcctgtaattccagctgctcggaaggctgaggcaggagaatcgcttgaacgcgggaggtggagtttgcagtgagccaggatcacaccactgcactccagcctgggcgacagagagactctgtctcaaaaaaaaaaaaaaaaaaaaaaaagaagaagaagaagaaatacaaaaccaactctttatagtagacagtttatcccccagaaagctttttaggctgaaaacgtttctatagattttggatttccttctgatagctaaaatttgtttctgtataacagagtagtgccctataagccagttcagtgcacattaaatggctgttcttagaattatgaatctgaggcttatgcagtgaggctctagctctctggagtcagttggtcaagtgggattcctgaggactgagcaaacacacacagagcaggattttgtcctaagttttcttagggatcctatccaaaaacaccattacttgaatttcccagcttccttttacagggagacttccttgctatgtgtactcccacctcggtatgtcaaatcattttctcagaggaagtacagcataaaataataaccagcatttgtagagcacttcttgtgggccttcttgggcaaatagacattctcatggaatgctctaaaattgttaagttcttgcacttgctctcaagtcatttataatctaattgctggtcttcctggtatgaacaaagatgtttgcttgttaataaattcctaccacatacccagacttgtggtttatttctatctaactagggaaagcactaaagagttttccaataaggaagaatgatctgagtgtctacctgctttggaaaagatgtctgccatggataggaaatgattttgtatcccaaaatcctagtactaatttggagtgttgtaaaggtcagggcagcaaatgctagagagtgggattaatgaaaagttatagtgttctgcatgcctttgaataattaatttttactccatttttactcgcttgcaataaagtaggttaagtgctgtactttaaggaagtccatgtacaagccagtgccttaacaatggtcaaatggttgctcactaaccaatggaaataaatgactgttgtttccacaaaattgctttacagattctaaatgctatctctgggacactggattgtgtgctctttaagataaattccataatcaagggcctggccctgaatagattggagcccaaaaatctcactgaagcaaagagataataggccagtaaagagtgggagacaaacactcctggaataggaagccactactcacctttattttaaattgatatatagaaattaatattacaaaatgcacacatcttaagtgtgaagtttgatgttttgacagttgtatacgtctgtgtaataactaccaaaagaagacataatatgttacaattaacccagaaaattctcaagtacttttaaatcacccctgagcacctccccactccagtgatcacttcttgatttttatcactaaagatttgttgtacctgcttttggattacatataagtggaatcatataataatgtactcttttgcatctggcttctttcactgataatgctttaaagacacgcatactgtatgtattaggacattgttctttattgctgagtagtatttcattctataaatataccacaatttgtttattcattctcctattgaaggacctttaggttgtttccagtttggggcaattatgaataaggatgctatcgatattcttacacagccttttgtttttgttttttgtggatatacatcttcacttgtcttggataaataagagtagaaaattactgggtcatatggtaagtgcatgtttataagaaactgccctcttattctccaaagtggttttaccattttgtactcctatcagtgatgtatgagagttacagttgcttcacatgtctgtcaacatttacactgtcactgttttttatattagccattttagcatatatgaaataactgattttaatttacattacatttccctgattaatgagttgagcactttttcatatgcttatttttcatttgtatatctttcaagaagtgtctttcatgtcttttctcattttaaagttgggtgtctttttattgtaggtgttattctttgtattttgaatataaatcctttgatagatatgctatgattttttaaagactctatgtattcacttattgggatctttcgatgaacaaattttttttataaaatccactttatcagttttttattttatggttttatgacctcaaagtcacaaagaatatattttcttctagaagttttatggtttgggattttatgtttaggtctgtgatccatctcaaattaatttttgtgaacagaatgaggtttggtttttttccaacatggatatacagttgttccagcaacatttacttaaaaagacttttctttacccattagattgacttggtagcttggttaaaaattgatcacgtgtgtgtgtatttctacattttctgttctgttccattaatctatttgtgtatccttacatcagtaccacactttggattattgaaactttctagtaagtctttaaattagtaaatccttcctttttgttatttttcaagatcgctttggttattgtcgattctttggattgtcataaaagttttacaattagctcatcttgtttttcaaacgtagatgtgctgggttagctgtgttcatgccactgcattccagcttgggtgacagcaagaccctgtcaaaaaaaaaaaagaaaagaaaaaactgctagaatcttgatatggggttttgttgagtctataggtcaatttagaatgaacattttaatagtattgagtcagctaattcatgaacatattaagtcttgtcatttatttaggtattaaatttttttctcagcaatgttttgtagcttcccttgcgtaacacttgcttatcttacattagactttttcttaagcatttgatttttaaaatatttttgattttcttttctttttctttttttctttttttttttttgagacggagttttgctcttgttggctaggctggagtgcagtggcgcgatcttggctcactgcaacctccgcctcccgggttcaagcaattctcctgcctcagccttttgagtagctgggattataggcacacaccatcatgcctggctaatttttgtatttttagtacagacggggtttcaccatgttggtcagcctggtctcgagctcctgacctcgtgatccaaccaccttggcctcccaaagtgctgccattacaggcgtgagccaccgcgcctggctaattttcatttttaagttgtttgctgctagtatctagaaatacaattgattttttgtttgtttctttagagatgggtctcactatgttgcccaggttggtcttaaactcctgagctcaagggattctcatgcctcagccacccaagtagctgggactttattcacgtgccagtgtgcctggctgatttttgtatgctgatcttgaatcgtgccaccttgctaaattcatttattctagaaatagttcttgtagactccgtagagttttatattaaatagatacacaacagtgtagtctgcaaataatgtttttacttctttttctgattttatgccttttcttctttttttttttttttttttttttttttgtctttctccactggctacaatatctagtgcaatgtttaacgtgtggtgagagcagacaccttgccttgttttcttaatcttagggataaagattttaatgtttcatcactaagtataatgttaactgtaagtttttcacagaccagcccaaagaagttcctttctattcctaatttgttgataatttttattaggaagggttattaaattttgtgagatgcgtttttagcttttaataagattattatgtatttctctttttattttgttaagatggtatgttacaggggttggcaaactgtggcccatgggccagatccagcccatggacagttttgttgttgctgttttagagacagtctcactcttttgctcaggctgccaggctggagtgcaatgacatgatcatagctcactgcagccttgagctcctggactcaagcgaccctcctgcctcagcctcctgagtagctaggaatacaggtgcatgtcaccacaccaggcaaatttaagaaattttttgtagatcttgccgtgttgcccatgatggtctcaaactcctggcctcaagcaatcctcctgccttggcctcctacagtgctgggattagaggtgtgagccaccacacttggctctcatggactgtttttgtttttgttttgagacagggtctctgtcacgcaggctggagtgtggtggcatgaacgtggctcactgcagcctcaactttcttggctccagcaatcatcctgcctcagcctcccgagtagctgggaccacaggtgtgcgctaccacagctggctaatttttctttttcatttttgtagacatggagtcttgatatgttgcccagattgatctggaactgctaggctcaagtgatcttcctgccttgcactcccgaagtgttggcattacaggcatgagacacagtgcccagcctattgcagtgttttttgttttttctgttttttttttttttttttcatctttgtttttgtttttttgagactgagtcttgctctatctcccaggctgtggtgcagtggtgcaatctgcaacctccgcctcccaggtttaagcgattctcctgcctcagcctcccaagtaagtgggattataggcacatgtcaccaagctcagctaacttttatatttttagtagaaacggggtttcaccatattggccaggctggtcttgaactcctggcctcaggtgatctgcccaccttggcctcccaaagtgctgggattacaggtcactaggcgtagtagggctactacgcctggccctactgcagtttttaataagagatgagttctctcagcttttgtctataagagaatgtccttacttttatttttgaggggtattttagttggatataggactctatgttgaccttttatttcttctttcagtactttaaagaagttattttattgtactcaggcctcatttgtttctggtgagaagtcattcatcattttaatttttatttcctttccgtaatgtgtggttgttctcaatggctgcatctgtgcattatatttacttttcagtagattgactagggaatgtctaggtatgtttttctttgtatagagtttactgaacttcttggatctgtgttgatgtctttcattaatattggttctttcttggccgttatccgtttacatttttctcttgtctcatactctcttgcttctcctcttctttggagattctagttacatgtatattagatgatttgatataaacctacagatctcagatgatttttcccctgccctgttttctttttgttttcagtttggatactttccatttaaccatctttaagttttttgatgctttccaatgttaacctgttaaacttgtttattgaattctccatttaaaaatttttatttttagttatttatggatacatagttgtactgaattattcatttctaatatttttatttctagcatttcattatatttgtatagttacaattttctgctgaaatttcctatttcttcatgcatgttttccacattttccattctactttttagcattttaatcagttattttattgggttttttctgttttttctttcatttttaatcagttattttaaggatccaaactgataattcaacatctgggtcttttctagttctgcttctattgagcccttcctctcccttaccatgaatcttattttcttgcttttgcacgtcttgtatatttgattggatgatggacgttttatgttgaaaaaaaaaagaaattgaagaaaatgtttacttccaaaacagagcatgccctttgtttttttttcaggccacttgaatggtggctcaatctgatgtatatgaattctagactggggcttcactgcagttttagtttgattcagtttgcctctagcttcaaatatttgaaggaacgtagaatcagaactctcatatcaccagggcctgagttttgggcattggcaagattccagagatctgactttgcttcatagctaagccaccagcttttatcaatgtgggagatctttccctactttacaaccttgctgccaggatttttttttttaatcaatgggctggggataggaggatctttctcagctctcatgtgtgccctgcccttttgtagaggaatgcccacaatgcctaggggatgggtttctcagcatttctgaccccatttaggctccaagagtgcctctgttggatttcacaacaatcctgcctcccctttcatttttaaagggtattttgcccttgggagaagtcaagctctctcagcgttccttctattatccacacctttagtgtactacaccttcctgtacctggttatcatctaaggggtaagattggtgggaagccttcctctgtggatttgggtcatctaggttctaatgtcaaaccagcctccaaggggttgtgaaaatgttgttaaatttcagcaggtttctcttttctcccccctgtagtattcctcttcctaccatagttcaactaggaataacaacagctagggggtctcttctctcctatgaaggacttggcactttctggagtttggatcatttaggtttctttggtttttgtttttattttgagacagggtctcactcttacccagcctggagtacagcctgtagtgatctcagctcactacaacctctgccttcctggctcagttgatcctcccacctcagcctcctgagcagctgggactacaggcgtgtaccaccacacccggctaatttttgtattttttgttgagatagggttttaccatgttgcccaggctgatctcaaacttctgagctcaagcgatctgcctgcctcagcaccccaaagtcctggggttacaggcataaaccactgcacccaacctagatttctttgtgtccttagctttctgatgaattaaacatatgttttattttctagctcatctggccttttgttgttgtttgctagagtgggaggtatattccttgtgactttgttcatatcactagtgaatttcagaagtaggagtttatttttttaataaaaaatttttttaggtcaggcacagtgtctcatgcctgtaatcccagcactttgggaggccgaggcaggtggatcacctgagatcaggagtttgagaccagcctggccaacatagtgaaaccccaactctactaaaaatactaaaattagccaggtgtggtggtgggcgcctgtaatcccagctacttgagagactgagtcaggagatttgcttgaacctgggaggcggaggttgcagtgagccgagattgtgccactgcactccagcctgggtgacagagcaagactccctctcaaaaaaaaaaaaaaaaatttttttttaaacacgtctcactgccacccaggcttgagtgccatgacatgatcatagctcactgctggcttgaccttctgggctcaagtgatcctcttgcctcagcctcttgagtagctgggaccacagtcatgtgccaccatgcctggcttttttttttttgtagagtttgggtctcgctatgttgcctgtgatcctcccaccttggttttccaaagtgctgggattaaaggcatgagccaccatgcctggttaggaatgggagtttaaacaatggttttatttacatatttcattagctagtatttttttcttttttgagacagagtctggctctgttgcccaggctggagtgcagtggcacgatctaggctcattgcaacctctgcctcgtgattctcgtgactcagcctcctgagtagctgggattacaggcgcccgccaccacacccagctaatttttgtatttttagtagagacagggtttcaccatgttggccaggttggtctccaactcctgacctcagttgatccacccgcctcagcctcccaaagtgctgggattacaggtgtgagccatcgctcctggcctcattaactgttttcaaaagtaaaagtacatggataatacaaagttaaattttgtagaatcataaagaaaagcaacaccttcccatcttaactcccctagtgcctctactccctccacagagacaaatatcttaccagttggttgtgttttcttttccaaactgtatttctaaaatgtgtcaatatctcttccttttattttttattttttgtagagacaggggtctcactgtgctgcctaggctggtctcaaactcctggcctcctacctcgacttctcatagttctggcgtgagctactgcacctggcctcccccttattatttttttaaacatgaatggaagcatactatattttctacactttatttgttttatgtaactattttaacaacctgaggacttttacaggctgcataatatgtcttaatatggatgtatcttagtttatttaaacagttactggtgatggacatttccatgtttccagtattttttctcacaaacaatgcagtattatgcctttgtccacattcaccattgattgctattgagtatatctgtagcatcaagaataggcatactgaaaatcctccatgaagtccagtgaagcttcatattattttgaagtgatatttcccagtgttggctggactctcaagcgtttgtggtataggttttgggaggactggacacttccaaagagaaataagatgttacagacttgtccagcaggtggcatcagaacaaagctggctatggaccttgtcagtacaaatgataaaacattaaaaatgtaaaaactcaactgtagctccttgtttatacatatattgggggtgttgaaaagttaccgatgcctgattcctcttctatgtcctcagcccccaccataaaaatagataaatgccattttttttgtatgcccagcacagctatatgatttgaataatcttgataagcagggtcacatttgaggagatttgctaagggaaatgaagatccatctgtgacacaagaaacatgttctatgtgatttctgggattttcctgtgaacatacttcttgtttgtttgttttacagtggatctcactctgtcacccaggctggagttcagtggtgcaatcatagctcactgcaaccttgagctcctgggctcaggagagcctctctcctcagtctcccaagtagctaggactacagacacatgccatcatgccaggctcattttaaaattttttgtagagacgggtctcactatgttgctcaggctggtattgaactcctgggctcaagcaatcctcctgcctcagcatctcaaagtgttgggattacaggtgtgaaccatagtatccaacctattatgtttttttaaaaagagattgttctaattatgtatataattaaagtacattaggtttagtgattgcaatttgagaaaccaatgtcctttcttattgaaaaaggccctggtacagaaagtgttctatcttcctcacaagatctgaggtcaaaggagagattttgaaacattatagcaatggcttctagttattgaataaagaatgtcatttgctcctcacaggacccctttcagggagatttcacatattgggaaacagcctcatgagctttctacaaacatctttgtccttaagtcttcccatttcagtaattggctgtaccactcatccagcagctttcaaagtaagaaacctggcaatcttcctttaacatccatttccctttccctcattcccccatatccaatcatgtgtattggaggtttttccacctctaaacttgagaacccatttactttttctccatctcctttgccatcacactagtccaagtgaagtgtttcatcatctcatttgcagcatcctttagtttaccctagattatcaatttttgtccccctcccaattcagtctctactcatgagctaacatgagtttattaagtgttcattctgaccatgccattccttgctcaaaattctctagtgccttcccaatgcccttaaaataaaattcctcatatggcctttgtggatctgcactcctacctcttctcctattgcaaccaaccctgttacctttttctcttttcacactggtcttcattctgtgctgcaaactggctgagattcttccatcctcagggcctttgcacaagttcttcctttgccttagaattctttcctggcctgcacatgtcttcatcccctttccctaagctaatgccttaccctttaggtctcattttaaacatctcttacccaggaaaaatttccctgtccaaacaagtctagattggctccccattgtttgttctaactgttctatatttctccttcttagcatttatcacaattcttggtatgttgtgcttttcactttcttagtcgctattattggagtaggtaatacatccatatagtacaaaattcaaaatgtattaaaggtatagagtaaaaagtcttctcttccctgtccccccgctacccagttctcctctttagaaccacttttagcattttgaatatccttccagaaatattttctaagtatacaagcaattatgtatataatattcctctttatttttgcctttttattaatacagatactatatgcattttctgcactttatctgttaataatatatcttggcaattattcaatattaatatgtaaatagttgcctctttctttttcatgcgccatataatatggacttataatttatttaacctctatctaggttggttttaggcattggttattacaaataatgctgcattgaatacctttgtatgtaaagtcatttcccacatctatgcctatagaataaattactagaattgaaataattcagttaaagattatgtgcatttttaattttggtagttattgccaaactgctctcaatggaagttttatgaattcccactagtgaatgcatttgtcctcacaattatgtcagtgaaatttttgttctttgccaatgcaagaaatggaaagtatctcttggaaactaatttgcatgttttttttccttgcacagttatattttcatatgttaaagagccatttgtatttcttggtgaattgttcataaactttgcttacttattatctaatgtctgactaatttgctacactctaaattcccaattcatacttaagtctcgcccttgcaatttagatgtacaatctgcctcttcagtggtttccacaccaaaaaatccacaggctcctgaattttatatgggcctaagagtcttactgaaaattggaagtcttaaggtgtagtctattttatgcagtgtgaggcctttcatgctctgaaatgtaccactcttgactgactttttcttcttcaccctgtccggcactgtgcccttattagccagagaaatgttccccctttctcccaggaaacgttctgaccttaccctggtccctcaaggactctccttctcccccaaattaactttcaaggagtttctccaacccaaaatggcacccttcctgaaaagatttctagtggatactgttttctgtacctcactacggatgtattttgctgcttggctccccgtctccattttgctatggcaaacatttttttccagaaatatatcagataaaatg

SEQ ID NO: 1545 - DNA, 807 bp, Homo sapiens
  ENST00000570085
cgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaagtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtag

SEQ ID NO: 1546 - DNA, 612 bp, Homo sapiens
  ENST00000564062
ctcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaaggcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttg

SEQ ID NO: 1547 - DNA, 319 bp, Homo sapiens
  ENST00000567762
ccgctacgaggtgctcacggccgagcagattctacaacacatggtggaatgtatccgggaggtcaacgaggtcatccagtgcatattgggtacttccagaagtatgaattcagtgatgcaaaggacaggcgggctgcagcagcaaagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacagg

SEQ ID NO: 1548 - DNA, 403 bp, Homo sapiens
  ENST00000561987
ctttctaatctatttttattcttggtttcaggcgcctgatcacagattcaaaagttaaattaaagtatcagcatttaataacaaatagctttgtagagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcggg

SEQ ID NO: 1549 - DNA, 559 bp, Homo sapiens
  ENST00000565950
cactatgtgctagttctactactaaattctaggtaattaactgtaaagcagacatgggttctctccttgtatttgccagtcactagaaactagtgacaatactgtggaactataaggcatgaaatgattggcttatttacttgcttacagtaggtaggccttaattctattaactctttgtgtcacttaacagctttaactgtggagaaaattggcatgatcctgttaaatgtaagtggttaaagaaatggattaaaaagtgtgatgatgacagtgaaacctccaattggattgcagccaacacaaagtttctcttcataggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctata

SEQ ID NO: 1550 - DNA, 478 bp, Homo sapiens
  ENST00000561770
taatgaggatgatgcaaaggcagcaagagatgcacaggagtgtctcgctttgtcgcccaggctggagtatagtggcatgatctcagctcactgcaacctccacctcctgggttcaagtgattctcctgcctcagcctcctgagtagctgggattacagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgaga

SEQ ID NO: 1551 - DNA, 630 bp, Homo sapiens
  ENST00000566063
tcaagagtctccttctttctttatctttgccaagacttatctttcatctttttgataaaaaccattctaacaggtgtgaagtgagacttcattatggttttaatttgataatcagcttttatgtacagtttatgtgttataattatatcacccaatttttcttaatgggacagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggact

SEQ ID NO: 1552 - DNA, 604 bp, Homo sapiens
  ENST00000562891
cgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgta

SEQ ID NO: 1553 - DNA, 4068 bp, Homo sapiens
  ENST00000563310
ggttatctttagtggagaaataatgactaaaaagccagcttttagcagtaaaggttttctcaagtaaagatgttcatttaaaattgatgcataaaacattgatatctgtatatgactagacaataagactgactagcagatgggacttcagttgggtaacaggtacaaaactagccatagtggtaaaggatgatacaatttgaatcttccatacagtgttttcttataagaaataagtatagccagatgtaagcaataataggtttctattttttctcatttacctttgagttttcagcaaagagcagctctcagaacgagaagattccaaaagacattttaaatcctttcaaatggtcttcagtattcttccaaaagtaatgggtgaaatctttcgttcttttaacatttaaaaaattgttctggaaaagaacaaacaagttattagagatgaaagcccatagagctttacaggtgcagttaaaccacctatgaaagttacagaatgagtgttgagagcagtctgtagtcaacaaaacagtgaaaatggtttatcttttagctttattttgaagccaaaatttactttcattcttcttacagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttgttattcc

SEQ ID NO: 1554 - DNA, 1296 bp, Homo sapiens
  ENST00000396662
ggggcggggactgtcgcgtggagctgccgggcgagcaccgttagggcagcctggcgcgcggcgcccgccaggcgcccagtcctctgccatcgcccacgcctccctggtgccagggaacaggtatcagcgcgcctccccagcggctgggagagacgctgaatgaagaagagggaaggacggttagtcagagctgcttggagagctaagctggaagggtgcttatccctgcgtagaaacgcctgccaatgctttctcatttggacccagactccagatcgggagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtgtct

SEQ ID NO: 1555 - DNA, 1147 bp, Homo sapiens
  ENST00000356797
ggcgcgcggcgcccgccaggcgcccagtcctctgccatcgcccacgcctccctggtgccagggaacaggtatcagcgcgcctccccagcggctgggagagacgctgaatgaagaagagggaaggacggttagtcagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtg

SEQ ID NO: 1556 - DNA, 1144 bp, Homo sapiens
  ENST00000396664
ggcgcgcggcgcccgccaggcgcccagtcctctgccatcgcccacgcctccctggtgccagggaacaggtatcagcgcgcctccccagcggctgggagagacgctgaatgaagaagagggaaggacggttagtcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtg

SEQ ID NO: 1557 - DNA, 845 bp, Homo sapiens
  ENST00000439721
gaagggatcccacttcggggaggatgggcttatcccggcgggcgcgccaggtgggatctctagcgcctcaggggcccgcgcggcaacagccggcaccctcgggcccgcggacaaagggttaacgcgttggcagtgactgcgggccccggatgtgagagccttggcttgacgccctggctgcgctgcaggtgcgccgggccgaacggagccggcagcctggcggcgacctgaccgcccgaggctccccttcacctgcagcggctgctcggctccctctgggaacgccgccttttctaacttaagggcaacaggtggtgccggtggaccgagagagagctcagctccgccgcgctgggagcggcagttaccctcaccaattagggagcgggggcgggagttgcatggcttccctgatgcgggtgaccaatgggatttgggatcatgagtggaccgggaggagtgggcgtggtcggagtctgagtccaaggtttctcgtgcggcaactgccagagctgcttggagagctaagctggaagggtgcttatccctgcgtagaaacgcctgccaatgctttctcatttggacccagactccagatcgggagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctac

SEQ ID NO: 1558 - DNA, 840 bp, Homo sapiens
  ENST00000404894
agctgcttggagagctaagctggaagggtgcttatccctgcgtagaaacgcctgccaatgctttctcatttggacccagactccagatcgggagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaa

SEQ ID NO: 1559 - DNA, 3212 bp, Homo sapiens
  ENST00000396663
tggcttgacgccctggctgcgctgcaggtgcgccgggccgaacggagccggcagcctggcggcgacctgaccgcccgaggctccccttcacctgcagcggctgctcggctccctctgggaacgccgccttttctaacttaagggcaacaggtggtgccggtggaccgagagagagctcagctccgccgcgctgggagcggcagttaccctcaccaattagggagcgggggcgggagttgcatggcttccctgatgcgggtgaccaatgggatttgggatcatgagtggaccgggaggagtgggcgtggtcggagtctgagtccaaggtttctcgtgcggcaactgccagagctgcttggagagctaagctggaagggtgcttatccctgcgtagaaacgcctgccaatgctttctcatttggacccagactccagatcgggagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtgtctgcctagtgttttgtgcttacatctttcggggggaagcctttgcaagaaaattgcatacaaggctttgtaacgatcaagtgctaatcgatggaaatgttaaggtagattaacatatatgcagttatattgatcacattggtccaaccagtccttttttgaagtaagggacaaggagtaagtattttcttttttaagtttctgccaaatgatttttgacgctttctggaatcaagtaatttaatagtatagcttaattctagacaatgtttaagttggtctacctttattaaaaataagatatttggggtatattcaagtgcatggattagttttcctgacaaagcatgttttggtgtgtagtcttactttttagaaatagctatgcatcgttctacacaggtttaaaacaacttttttggggatttagggctattataggaatagtttgttgtcagaagcactttcacttgaagaacctaaaatgattgactcattcatagtaaatatgggcatgtaaactaataaatatgcactggatacatatatggatttatgaagaaggcgatttagtcaagaggatgtaattaaaatatgtggtctctaaaatattccagttacaagatatttgttttattaatatttgctggctaaaaacaaatgtggtttttatatatttttgtagtgtgttgagaagagcaaaagctttataaatatacctgatgcgctgtagaatgaaaatgtaaaagataacctgtatgtgttccgagctttaattttttgtttacaaattgaacagtgttacatgggctgtccagtcctgattatagagaggaagaaatggtaacagtatggcagataagaattacaattatagaaaatgaggggaaaataacaaacctgttttatgaaaattcactggtgctgtttacattggaataaaaagctctataaggaggaaaggcctttatctaattcttatctacagacacttacttccagtgaccatattttactaaatcagcttattttttatgtctaaagcaacagctgttctgaaaaatcaccaaaagaaatgcactttgctagcaggatttgttttggctttgggttttgtttttttgttttttttttttttcagtggcataacagtttttggaaccttgattcttgtgtcacacaaaatgaatgaagtagcttgatgtggagccttcatatgttaaatattcctgcactagtgatggtcacttagaatgtttatagaaatgtggataataactaccaataaactacttgaggcactaggagaacagtatttgactttgaattttaatgtatttccacttttgctgaagcttttaatcagatgtgtaaaaacaattgaccagctaggctatttagtcccatagtagttcagatctgcttagatgtgacaggcattgaaggctgtttttttttttttctcccttcactgatactgaaatcatggtatctgctgcaaacatgagtagatccatgatggattaataaagcttgctgaaaaaaaaaatctgtgtatcaattagatttaccagtttgcctgtactttctgtctacctactatgtaaaatagtgctgtttttaagtatttcaaaagcttgtgtgttgaccctttgtagcctaagtacgtaaacaaattaatgttatctaagtttttcatatttcatggacaacaaaagagaaaatggtatgaacactgtacaaactttgatttataaa

SEQ ID NO: 1560 - DNA, 7196 bp, Homo sapiens
  ENST00000377275
ggggactacgggtcggcgttgggctcagtgggctcgaaacaaagggctgtccggtggggattcgtcgcggcgccttctgagtggtcgggtcgaggcttctcggcctagcagtgccctcgctgcgcgatctcaggcgggttctcctcggctccgcgcagcccgcgccgcggtgggggacccggcgcagcggcacctgctgccgagggaccccgcggcccgccccggtgctcgtgatggggctgatcttcgccaaactgtggagcctcttctgtaaccaagaacacaaagtaattatagtgggactggataatgcagggaaaaccaccattctttaccaattcttaatgaatgaagtggttcatacttctccaaccataggaagcaatgttgaagaaatagttgtgaagaacactcattttcttatgtgggatattggtggtcaggagtctctgcgatcatcctggaacacatattactcaaatacagagttcatcattcttgttgttgatagcattgacagggaacgactagctattacaaaagaagaattatacagaatgttggctcatgaggatttacggaaggctgcagtccttatctttgcaaataaacaggatatgaaagggtgtatgacagcagctgaaatctcgaaatacctcacccttagttcaattaaggatcatccatggcacattcaatcctgctgtgctctcacaggagaagggttatgccaaggtctagagtggatgacctcccggattggtgtgagataacttttttgcttgaaagagactgctctatttattctgtgacatgaacattttttcctagtacctttggctgctaaggcagcagcatgtttaatttataacaacacaaacctctgagagcaacacttgaatcaagtgcagctgaactggaacataaaagattttttcttaactttttttttttaacacactaatcttcagttggatgaatgtaatgtataactatgttttcagcaacaattcttctgtttattctaattaatcagtgactgccttgtaagaaatgtttgtcatatgcgtgatgtcttctgaaatattcttataaccttaatgaccaattgctttcaattcttgaccagcactccctcccaaccagagaattactggtttgatagagtagtcttggaaaccatcaggtactgcctgcagacttctccagcactaaatatatttgttccctctataaaccattcatctttcggacagaacttactgtaaagaaagaaatctgcctagaggatatatgtaaggaagattccacatcatgagtacttgccttttaactttcccccacattactgttgagtcatggaataatgtttaagttgttatttgcatggaaattaagtaggctgtttatttatctaaaggaatcaagtccactcttctgcctgcaacatttgttcaaaaactaaccaaggtaaaatatttatttgaaagcccaactttgatgttaaatattcttgaataaatctgttattttaagaatatcacattattcaatgcatataaaactatcagaagttagtaaatcataccagcactaaaaataagacaattggaatatattttagcatcagtttacaaacaactttattatcaacagaaattttagctcttttctttgcaagatatatcacagctgctttgggcagtagctgaagccgaagtatgaacagtccattttgtttcttaaaatttgaagtcgtgtctgtcatagcatttttactaccagcagtatgttacttaaaaaactacatggctttccttgaatttatttgacggtattatgtaatagacttgaaacaattgccatctttgtagttatgccttgggttctaaaatgttataggaaactgctgaattgaatcctagcttttagaatattaataggagactcaaagttaatattcttaacaacttaaaattaaaaaaagtcataatctatcaaaagtttatttattggatggcattaaaacatttttgaggcagttgtctaatatgaacaataatctaaacaatatattccttaaattaagaggaaagacaagtgtcgtatttcgatcctgtttattcaaatgtgtgattttgctgaaatgaaagggataaaatgaatacttagagaataatacttcatttttgcagtactttttaattttgataaaaaagatacaaagttcataatatcaaaatatgtgttcaaaattggtattttaattttaatatttttgtaagttgatttaaattttgctcttttttcaggtgtgcttggtttattatatttagtcaagttaatttagtcgaatgtggtaacatttttctgatttatctttagttggagcacacccttgaactgaacagtggccaaaggaaagctttctgggctttggaaagtagttgtttaactttgttttaagccgttttcttagtgattctgtatcaagtagaggataagtgtagtttaacttagtttttaatataacccataatcaagaacatgagcgaaaagcagacataaatcgatatggatggtttgtggtgtgtgtgggatgtgggggaattaagaaaatgccatttacctaagcacagtttgcctgaatttctgcttggttgtgttgtttaccgtaagtactgagggtagtttccctaagtctgtcctgagaaaaagcatacttagtactcctgtatttgttcttatgaaatgactatctgccttcttgtatctagtaagattggctggctcaattttcttctgtcaaattatatggttattttttatattaccacatcagcattatattaaaagtgtttttaatagttgattgtattttgccaactactagtatagactcaaatttgctatttaatttttaaaatacaatttattttgtaaatcctttaaaaaatatttggttagttttggattagaaatgatttatgttagccatgtgttgaagatgaaattggcatcagtgtagacggtgctgattgggaaaagttcatgattaggaaattcatgtaagactttttaagagtattttttaggttttcactcaatctttcctgtcacagtaacgtgaaaactgattattctttactccaagagaatgttttaacccaagcaagtatctaatactagagcattggttctgacattcattgtaaatcagtgaactgtaagatactgtctaaaaaatgtacatttgtaattagtgcctttattcatattttgaaataagttcttagttttatattatacctgttctttagaagtcatgttagcagctaattatttcagtgatgaaataatttgtgttttatatcccccttcacctccatgtattggttagcacagtttatagtaagtgaaaagcaagggacccacctacattaccttcaggagactgttctaccttttaatttgaaaacaaggaaattaaattttaacagaaatcttttaagtatgttataaccaaagtgttcaattatccttgcaagttcaaatacagcatttttcttaattttgagcgtgtcatgtccttcatctttaaacccatcattcttattgaagcccatttgagaactcttagaattaatagaaccttttataagggaatatatggaatattttttattgttaatgtaacttaattccttaaaacctggaatattaatatatataatctattaaaagctgaagattaaatatgtaatttttgcttttagtttcttgtgttagtatgcttaaaggtatcaatacttttattctatattcattagaagaaaggtaataaatttaagtttcattgctgaaaaattttaaatgagtgccaccccatagccatagtcattttgattaagcataatttaactttcattatagcataaagagaaaataattattttagtatggaaacagtgataggcagtgctgtaaacaatattctctgaaaagttgtgggggtcacaaagaaaattttaaagaatatagaagcttttttaaaaaatctttttagtgtagtttcttagaacaaattataaacataatcattctgaataatcaatttttatttagtccttaactatgtaaaaccgtatcagtagaaaaatgtgctggtgtcgtgtctaaagatggataaatttctttggaatttatctttggagaccaactttatgaggcagactttttgtctacagctttggaaccaaaaaaacttcactctaattcagtcctaaaggctattttacattttgccggggtaaagtgacttcaagatacagcatggtgtcttgtatctagtagaatattgtgctagccatctaaaaaagtggatttgagccttaatttggccgtttctcaattgtctagttgaccttagacaattagtgtccatggctttccttttgtttttcccatactgaggaacttaaactacagctctaaaatgtcttttggttttaaaattctgaatgcttatatactactattaaaaattaaaaatccctcaaatagtagggcaatacaggtaatatgaaattaaatgtatttttatccattatttgattcccacctgttattttatttagaatacgaatacaaccaagtagggaaaaacgtatcagtaactgctattcaacttaaattcagcgaattaatagctgaatagaaatagctaatgacaatgcaaaagagaaaacaagccatattgctaagaaaaggatagtaagctgcttagaaagaaccagcctgtgttggaaataattctcttctagataatttaccttattttcttggcttgtactaattgaatggaagtggttaatttgttcagagtttattgccgtttgatgccaccccagtctatagttctgtgtgactttccatattgaaagagtagggttagtagccaggttgtcagtcttttacaaatgtctacataaatgtctacataaatctgaaagtggtttatattcaaggttagtttttcagtagcgtctcctccttattcattcacttttactgtgaagactgaaatccaaaagccaggttccccaaaaaagtatttttaaaaaattttaggggaccaaaataaatagaggaagaccaatataaaaaaatatgttcaactattccattttaaatttaaagcagaaaaaaaaattgtgcccctcagacctaaaggcagctttaaatgtatatagtttggtgaaacatttgggaaatattaatttggaggtttagaagcatacgaaaaacaaattcaaagcacttgaaagtaaagacaatatcatgaggtcgaaaaaacttcaaaaggatattaggtaagagaaaatgtgaatgaaagcagtgaatttctgcctctcctcgtatttagggtacttaaaattactaaaaaatactgtctttttaccatacagctagatggcctgtattattcttaatgtggccaaaggagtgaagactgattagggttttagaatttggaactgtagtcacataaaggcatcttttgcatttcttaaaccagtaatctacattttctcctggaaatggagaaatatgaaatgtgctgtgcatagcttttggaatagaaaacaaagttttaaaagaatggatatgttttcttgcacaacttgtaaaattttaattaaaaaattacctcatttttcaatccataaggtgctttgctcaagtttgtgggatgtttgtaccatcccataaaaacccccttcacccaaactgtatttgaaatatgcaaaattcataactaagggatagcattccttggagactttgttttgttttactcttgtttaccagctgggccaacatggtagatatatgagattcacatatggtttcattaaagcacataggaaagtgctcagtcaatatttaattagtttaattagataagggaaaggagaaatcctaaatttgatggattcttttatactgtgaatatatttccatcagtgttggtaagatatcaaatgactatcagttgatcccagtcatcagtgacttatttgcatatttaagccctattcacaagagaccataatcattttaatcttatattttccctcaggaaatttagggactctgaagcccctattttattctcttggagtaaactgttgagtgtagttacaaaaacttttatttatgacttaaaaaaagtttagctgctatttcagtgaaagtgtaaaataaaacggtcatgatttttttcaattacagaatagttacaaattttaccatgttcatctattccacagagcatgttaaaaacaacaacaacaaaaacctaacagcaattacaaccttggtgttgcgtttattctaatcagagtgaatgattataatcacactttgctattttaacataaattggtgctttagagcattaaagaggaagcagcaggccctgtactcagtatttattatttcttgcctcagaatgcaaaacaactttaaagtgtctatattcatatatatgtgcatttcttaagatttaaatacaaactgttgttactccttaagcttcaggctttctgcgaaagctctaagaatatcttcattactatgcttggtcaactggaagatggtattaataaggtcagaattaggaattggattgctctgtgggtcctccggtattgtgcagaggaaagaaaaatgtctttcacaccacaaactgtgtgtctgaaccccagccaaacaaatgtgttccattggtccaatatataagcattaacaacaacaacaaaaaatttaaaacaagtaaattaatgcattcacatgatcacttcttgaaaatggttcaaagcatgttttcctgatggtgggattgtttaaatgacatgttttaaagtttttaatactttattagttatgaagtgcttcttttatatgttaagtttaggttgccagtactcataatttttatttctgcaattatgttataatgagttgtttgcatgcctacttaacccaagtaaaacgatgctgtttgctctggaatgttcatcttttagacaggttttggctcatttccaatcatggtgcaatatagtgtaacattcatttgttttcattcaacagttttatttttgtcataataaataattacttttccaata

SEQ ID NO: 1561 - DNA, 2141 bp, Homo sapiens
  ENST00000372829
gccgacgcgtgcagacgtccttctaatcctagtcttcgtttggtccggttgcactcttcctatagcccagagggcgagagggcctgtggcctgggggaaggaggacgaggttctgcctggatcccagcagtaggacgctgtgccatttgggaacaaaggaatagtctgcctggaatccctgcagatcttggggccggaggccagtccaacccttggagcaggaagaaacgcaaagttgtcaagaaccaagtcgagctgcctcagagccggcccgcagtagctgcagactccgcccgcgacgtgtgcgcgcttctctgggccagagcgagcctgttttgtgctcgggttaagagatttgtcccagctataccatgggccgcactcgggaagctggctgcgtggccgctggtgtggttatcggggctggtgcctgctactgtgtatacagactggcttggggaagagacgagaacgagaaaatctgggacgaagacgaggagtctacggacacctcagagattggggttgagactgtgaaaggagctaaaactaacgctggggcagggtctggggccaaacttcagggtgattcagaggtcaagcctgaggtgagtttgggactcgaggattgtccgggtgtaaaagagaaggcccattcaggatcccacagcggaggtggcctagaggccaaggccaaggcccttttcaacacgctgaaggaacaggcaagtgcaaaggcaggcaaaggggctagggtgggtaccatctctgggaacaggacccttgcaccgagtttaccctgcccaggaggcaggggtggaggctgccaccccaccaggagtggatctagggccgggggcagggcaagtggaaaatccaagggaaaggcccgaagtaagagcaccagggctccagctacaacatggcctgtccggagaggcaagttcaactttccttataaaattgatgatattctgagtgctcccgacctccaaaaggtcctcaacatcctggagcgaacaaatgatccttttattcaagaagtagccttggtcactctgggtaacaatgcagcatattcatttaaccagaatgccatacgtgaattgggtggtgtcccaattattgcaaaactgataaaaacaaaagaccccataattagggaaaagacttacaatgcccttaataacttgagtgtgaacgcagaaaatcagggcaagattaagacgtacatcagtcaagtgtgtgatgacaccatggtctgtcgcttggactcagctgtgcagatggctgggctaagactgttaaccaacatgactgtgactaatcattaccaacatttgctttcctattcttttccagacttttttgctttgttattcctgggaaatcacttcaccaagatacagattatgaaactaattataaactttactgaaaatccagccatgacaagagagctggtcagttgtaaagtaccatcagaattgatttccctctttaataaagaatgggatagagagattcttcttaatatccttaccctatttgagaatataaatgacaacataaaaaatgaagggctcgcatcatccaggaaagaattcagcagaagttcactttttttcttattcaaagagtctggagtttgtgttaagaaaatcaaagcactagcaaatcacaatgatctggtggtgaaagtaaaagtcctgaaagtattaaccaaactctaatttggagtctgtcccaaacaatattgagatatttgcagttggtacgatgtgatttgtaaattctttgtttttcattgtgcgtatatggtaaagagatcttttcagctgctattttggaataatgactatcatatatcataacagtgactgatgttggttgtaatggttgggtttaggatgaaccattttaaggatgccaaatgaaatattagtatttgtacacagaaagaatttattgatttgatcttattacctagattgagattttttaatctttcctctacctaaactgacaatgaattggttatacatcatgcataagctacacttttatattagtttatatttgttattctaagacttgtgtttcatcaataaagttgtgttttaagcagcagaaaaaaaaaa

SEQ ID NO: 1562 - DNA, 1145 bp, Homo sapiens
  ENST00000529181
gcggccgcggcggcggggagagcggagggagcgccgcccgcccgcgccgtcctttgtgtggcggcggcggcgcctgggcctgaccgggtccccggggctgagcgccgggctccgcgccgcccctcccgcgcccctgccaagcgggcgcctatcctctccgagcaagatggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggtcagtggagctccctttatgaggctgtttgactctagaaaacattcttggctgggcatggtggctcacgcctgtaatcccagtactttgggaggctgaggcgggtggatcacgaggtcaggagatcaagaccatcctggctaacatggtgaaaccccgtctctacaaaaaatacaaaaacaaaaaatttgccaggcgtggtggtgggcgcctgtggtcccagctactccggaggctgaggtgggagaatggcatgaacctgggaggcagagcttgcagtgagccaagattgtgccactacactccagcctgggtgacagagtgagactctgtctcaaaaaaaaaaaaaaaaaaaaa

SEQ ID NO: 1563 - DNA, 6558 bp, Homo sapiens
  ENST00000303329
cggccgcggcggcggggagagcggagggagcgccgcccgcccgcgccgtcctttgtgtggcggcggcggcgcctgggcctgaccgggtccccggggctgagcgccgggctccgcgccgcccctcccgcgcccctgccaagcgggcgcctatcctctccgagcaagatggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggttgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacatgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctgaacaacaaa

SEQ ID NO: 1564 - DNA, 6690 bp, Homo sapiens
  ENST00000533983
atctgtgatgacattttctcagcagaatacaaatgcagctacatttcctcccagaggtttctgacatttcttctacacggataacagattctcctaagaaggtgttggtcacaaggaagaaagatctttgtttaatccctctgaaaagtgtaggaggatcaggtgaccaaggttttttagaattttccctttttgggatctgacgccgacacactattttgaggcagtgacatcatctctttcctctggcgtgccctccttgcggctccatcattcaggccttgtcatctctcacctggactgctgtgaccttcattcattcccaggagaagtccagaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggttgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacatgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctg

SEQ ID NO: 1565 - DNA, 2458 bp, Homo sapiens
  ENST00000527771
tgacattttctcagcagaatacaaatgcagctacatttcctcccagaggtttctgacatttcttctacacggataacagattctcctaagaaggtgttggtcacaaggaagaaagatctttgtttaatccctctgaaaagaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgacca

SEQ ID NO: 1566 - DNA, 585 bp, Homo sapiens
  ENST00000525103
gacattttctcagcagaatacaaatgcagctacatttcctcccagaggtttctgacatttcttctacacggataacagattctcctaagaaggtgttggtcacaaggaagaaagatctttgtttaatccctctgaaaaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagt

SEQ ID NO: 1567 - DNA, 714 bp, Homo sapiens
  ENST00000531595
cgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggtatgcagacctcccatgctttgttcatggcaacaacttcttagggaagggatctaaaacagaagccaacctgggcattgcaagaccggaagaggaggcttgcccagtaatgtcactgaatgactggattttccatgcatgatgccaggactccactccatttctgtgaactcgactgtaccatagtgaagttcagacatctgtctttcaaaagctaccctgatgattccagtgtggaccaactactgctccccaatgcgacccctgccaacaaaccccacgcataaataaaataaaataaaataatacaa

SEQ ID NO: 1568 - DNA, 571 bp, Homo sapiens
  ENST00000558849
gtattttcgattgcttaaataaaatcgtggacacttttcttctttcccattcaccttgggcatattgttgatgacacaggtatttcccatttcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcac

SEQ ID NO: 1569 - DNA, 585 bp, Homo sapiens
  ENST00000525505
gaggtatgggaaaagtcctggcttagccctattgtcaccccttctgttcttcatgaccctctgttgtcttcttgtttcacaggcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacc

SEQ ID NO: 1570 - DNA, 2932 bp, Homo sapiens
  ENST00000622346
ctttgtgtggcggcggcggcgcctgggcctgaccgggtccccggggctgagcgccgggctccgcgccgcccctcccgcgcccctgccaagcgggcgcctatcctctccgagcaagatggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaaggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctg

SEQ ID NO: 1571 - DNA, 611 bp, Homo sapiens
  ENST00000450234
agagttggcctggagagtgagcggtggagggagtggaacaaggcttcgtcaagagtccccaggagtccaggggcgcccccgagacgggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggat

SEQ ID NO: 1572 - DNA, 3150 bp, Homo sapiens
  ENST00000428373
gggtgggactggcagagctacggacaggtgggagcagtcagacagcctgagagagggagaccagaacgcaaagagagcgagagcattaagtaggcagggagaggcacacagaaagatagacagcaacactcgcgtgctccctccctccacacgccctcctcttaccgagcgaagcggccaggggcacagagtgggagaggactgtgggcacagaagaccggaagagggacgctgcattgctggtgggacggagggattcggacggacggacagaccagcgcacagactggcagcctgcgagagtggcagctttgagagcagagcgcagcaaagcgagaatcccgcgccgagctgctagtcggacccacagacggtcggactgacagacgtgcagacggacagaagagcagacaggaggcgggggcgcgttcactcccggcggccagccggccagagaaggcggcggtggcaccttctgagcgcgtccggagcagagaccagcagcagcaggggcagcggggacacaagccgcgaccgagccgccgccgcagccctggctgccacagctgtgtgggatcccagccgacactgcagaaagctccttttactagcagttaaataaatcgaccaaaaacaaaacaaacaaacaaacccaacaacaacaacaacaacaaaagccaagccaaaagccaaaacaaacaaatccagccaaatcaatcattgagaaacaataatattaataaaatccaaaactaaatcaaaccaatcaaggcaccaagacgcaggggggatatccacagttcgatcaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaa

SEQ ID NO: 1573 - DNA, 544 bp, Homo sapiens
  ENST00000421492
aacaacaaaagccaagccaaaagccaaaacaaacaaatccagccaaatcaatcattgagaaacaataatattaataaaatccaaaactaaatcaaaccaatcaaggcaccaagacgcaggggggatatccacagttcgatcaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagcttaaaaaagtgaggaggaagtaaatgctaaattattcatgagcctcatttgacagcacatcagaaggggaagtgtcaggggttttataaagggcataaaatcttgttattttaatttgcatctgggagaatgtctgagcaaggagacctgaatcaggcaatagcagaggaaggagggactgagcaggagacggccactccagagaacggcattgttaaatcagaa

SEQ ID NO: 1574 - DNA, 3182 bp, Homo sapiens
  ENST00000444190
aatgtttatgcatagaaatatagctgaggtggatgtggttgctgtcagctattcaggtttgctacctgatcacctcctgaagatgtagggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggataaatctaggaaagatgactctgaaagagaaaaagaaaaggataaaaacaaagataaaacctctgaaaaacccaagatcagaatgttatcaaaagattgcagccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagtcagtttgctcccaggaaagcctttttgtggaaaacaggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagtctgtccaggggctgcaggcttcctcccagtcagtgcaatatccagcagtctcttttcctccccagcacctcctacctgtgtctccaacgcagcactttcccatgagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgacct

SEQ ID NO: 1575 - DNA, 657 bp, Homo sapiens
  ENST00000449196
tttgttaaaaatcagaaaacctttgacacacttttagataaatacacctactcctttgatcctttgtgtatgtattaccacagggcttaaatatcttaagattttagttaatgtcattttcatgaaagacagtcatttggaagccaagagctctatctatgttttgttcaaatagccgagtaatctactatcttggcagtaattacttctgctgcatttctaatgtgaattgcatgtgagagcttatgaatacactcttttcaagtgtatgtgggttttcaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaaga

SEQ ID NO: 1576 - DNA, 3433 bp, Homo sapiens
  ENST00000187397
gtgctattagatttgcaaattgctgatctcccagtgactttccctcttagatcccagttgagtatggttaccttgagaactgtggtattagccatgttagagcatgctccactggggagttctgtgcagtctatttttaatgctatttaatgaaggagcgagcgcctcactcagcaataaaagaagcatgagggaagacagagcagtgcatggttatggatactggacaaggatatttggaaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggataaatctaggaaagatgactctgaaagagaaaaagaaaaggataaaaacaaagataaaacctctgaaaaacccaagatcagaatgttatcaaaagattgcagccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagcaaaacagaatgcatccatttagagatgacagacgaagtaaatcaattgaagagagagaagaggaatatcagagagtgagggagagaatatttgcacacgattcagtttgctcccaggaaagcctttttgtggaaaacagtaggctcttggaagacagtaacatatgcaatgagacctataagaaaagacagctctttcggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgaccttatggaggaaggtcatgtttttaccaccagtttggttca

SEQ ID NO: 1577 - DNA, 620 bp, Homo sapiens
  ENST00000452563
gcagtctatttttaatgctatttaatgaaggagcgagcgcctcactcagcaataaaagaagcatgagggaagacagagcagtgcatggttatggatactggacaaggatatttggaaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggtatatccccttgccattatcattaatt

SEQ ID NO: 1578 - DNA, 590 bp, Homo sapiens
  ENST00000438577
agcaataaaagaagcatgagggaagacagagcagtgcatggttatggatactggacaaggatatttggaaaggtaaaggctgaccattggatatggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagcttt

SEQ ID NO: 1579 - DNA, 715 bp, Homo sapiens
  ENST00000414496
aataaaagaagcatgagggaagacagagcagtgcatggttatggatactggacaaggatatttggaaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagattgcagccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcg

SEQ ID NO: 1580 - DNA, 543 bp, Homo sapiens
  ENST00000419330
acaatatacaaggtagccagaagtgaatatgattgagaattctcattagtgtgaggagacagtttgaagtccataaggttggaaattgcaaattaatcatttgtatataagtcagtttaattcagatctgctttgtgacaaggttaggagagaatgtggggcttaaaggtgatgtcgacaatgaaagccatttcttcttatggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcag

SEQ ID NO: 1581 - DNA, 568 bp, Homo sapiens
  ENST00000427542
gatgcatttagtgttttcatagataggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggc

SEQ ID NO: 1582 - DNA, 572 bp, Homo sapiens
  ENST00000474696
cattagagaagaagcaggcagcttgagacaggtggagctggatcaagctgtgaacgtgatttgctggaagctggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaag

SEQ ID NO: 1583 - DNA, 2506 bp, Homo sapiens
  ENST00000412048
attagagaagaagcaggcagcttgagacaggtggagctggatcaagctgtgaacgtgatttgctggaagctggtcattagtgttagaaaccccgtcttatttatttcatccttcaccctaccatgattattgcaattattattatttatttttcatcttttttcaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaa

SEQ ID NO: 1584 - DNA, 2416 bp, Homo sapiens
  ENST00000396482
agagaagaagcaggcagcttgagacaggtggagctggatcaagctgtgaacgtgatttgctggaagctggtcattagtgttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttacc

SEQ ID NO: 1585 - DNA, 1015 bp, Homo sapiens
  ENST00000432682
gaagaagcaggcagcttgagacaggtggagctggatcaagctgtgaacgtgatttgctggaagctggtcattagtgttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagcttaaaaaagtgaggaggaagtaaatgctaaattattcatgagcctcatttgacagcacatcagaaggggaagtgtcaggggttttataaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcata

SEQ ID NO: 1586 - DNA, 574 bp, Homo sapiens
  ENST00000432450
gagacaggtggagctggatcaagctgtgaacgtgatttgctggaagctggtcattagtgttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggtatatccccttgccattatcattaattgcatgaatgggatcc

SEQ ID NO: 1587 - DNA, 550 bp, Homo sapiens
  ENST00000413378
gattattgcaattattattatttatttttcatcttttttcaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccag

SEQ ID NO: 1588 - DNA, 3086 bp, Homo sapiens
  ENST00000417925
aggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggataaatctaggaaagatgactctgaaagagaaaaagaaaaggataaaaacaaagataaaacctctgaaaaacccaagatcagaatgttatcaaaagattgcagccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagtcagtttgctcccaggaaagcctttttgtggaaaacagtaggctcttggaagacagtaacatatgcaatgagacctataagaaaagacagctctttcggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagtctgtccaggggctgcaggcttcctcccagtcagtgcaatatccagcagtctcttttcctccccagcacctcctacctgtgtctccaacgcagcactttcccatgagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacatt

SEQ ID NO: 1589 - DNA, 1304 bp, Homo sapiens
  ENST00000396481
aacagattttaactctgaaaagccatttccagtgtctatagactattgtgagcctggagaagtagcatttagttgggatagcttcactagagctgcctgccaaagacttccttccacaggatcttgtcgcaccagcaactgacaggagcttgggagctcgggagcttgggagagggcttatgtttttaataatgtagctgtcagttcgaagcctggaaatgttgaccctcaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcct

SEQ ID NO: 1590 - DNA, 3124 bp, Homo sapiens
  ENST00000434383
atttccagtgtctatagactattgtgagcctggagaagtagcatttagttgggatagcttcactagagctgcctgccaaagacttccttccacaggatcttgtcgcaccagcaactgacaggagcttgggagctcgggagcttgggagagggcttatgtttttaataatgtagctgtcagttcgaagcctggaaatgttgaccctcaaaggtttattgccaaaattagataccatatttatgctgaattattaccttttcaatagttttttttgaccttgcagactactgtattctttatacctagggaagcatgtctatgtttggaacctgcaaataatttttcagtcatcttagagatgctgcagaacatcaatgccacatcttgagtcagaagtcgagggtcatttgttcaaaagttggagaaatatcctcttttgttgcttcttctactctgtagtggagaatggggaactggtagttgtgtgggagttatgtgtctctaagatttgtcgacccattttgatggcaaggtgtattcacaagtgtgtgtaaagggggtgtggatgggacaactgcatctgcctcttgtgcatgccttgggtacttgatttcatcttgttttttcccccttttgtataaaattctcaaaattgctcatttggatttgaatatgaaaggagaaatgaaatctctaaagaatgatagtaaataccttgcactgactttattttctgatatcttaaccttctagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggtatatccccttgccattatcattaattgcatgaatgggatccacctttgtgtgcatgactcttaatttggtgttaaacagtgttttgggggagaaaaatataattgaagaaaataattcattttttggctttatcccctgcttatgcaacattctaaaatagtttaatggtttgtcacagagtattaaatttgtttttttccagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaa

SEQ ID NO: 1591 - DNA, 2880 bp, Homo sapiens
  ENST00000441454
agcatttagttgggatagcttcactagagctgcctgccaaagacttccttccacaggatcttgtcgcaccagcaactgacaggagcttgggagctcgggagcttgggagagggcttatgtttttaataatgtagctgtcagttcgaagcctggaaatgttgaccctcaaaggtttattgccaaaattagataccatatttatgctgaattattaccttttcaatagttttttttgaccttgcagactactgtattctttatacctagggaagcatgtctatgtttggaacctgcaaataatttttcagtcatcttagagatgctgcagaacatcaatgccacatcttgagtcagaagtcgagggtcatttgttcaaaagttggagaaatatcctcttttgttgcttcttctactctgtagtggagaatggggaactggtagttgtgtgggagttatgtgtctctaagatttgtcgacccattttgatggcaaggtgtattcacaagtgtgtgtaaagggggtgtggatgggacaactgcatctgcctcttgtgcatgccttgggtacttgatttcatcttgttttttcccccttttgtataaaattctcaaaattgctcatttggatttgaatatgaaaggagaaatgaaatctctaaagaatgatagtaaataccttgcactgactttattttctgatatcttaaccttctagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaa

SEQ ID NO: 1592 - DNA, 561 bp, Homo sapiens
  ENST00000436702
agaagtcgagggtcatttgttcaaaagttggagaaatatcctcttttgttgcttcttctactctgtagtggagaatggggaactggtagttgtgtgggagttatgtgtctctaagatttgtcgacccattttgatggcaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaa

SEQ ID NO: 1593 - DNA, 1103 bp, Homo sapiens
  ENST00000438071
attcacaagtgtgtgtaaagggggtgtggatgggacaactgcatctgcctcttgtgcatgccttggggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaag

SEQ ID NO: 1594 - DNA, 577 bp, Homo sapiens
  ENST00000461826
ttacaagggaaagagattcggtagaaggaaagcaaactgcacttacaaatagcttaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttattt

SEQ ID NO: 1595 - DNA, 700 bp, Homo sapiens
  ENST00000446068
ccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagctttgtccttcagttgtgcacaaattgagctggattatcaatacggaccgatgatcaaccggtgtagctgtaaagaacaaaccttgttatgcaaaacagaatgcatccatttagagatgacagacgaagtaaatcaattgaagagagagaagaggaatatcagagagtgagggagagaatatttgcacacgattcagtttgctcccaggaaagcctttttgtggaaaacagtaggctcttggaagacagtaacatatgcaatgagacctataagaaaagacagctctttcggggcaacagagatggctcagggagaac

SEQ ID NO: 1596 - DNA, 781 bp, Homo sapiens
  ENST00000425289
attttgcagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaattcagtttgctcccaggaaagcctttttgtggaaaacagtaggctcttggaagacagtaacatatgcaatgagacctataagaaaagacagctctttcggttggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggtgag

SEQ ID NO: 1597 - DNA, 787 bp, Homo sapiens
  ENST00000427590
ttgcagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaattcagtttgctcccaggaaagcctttttgtggaaaacaggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggtagttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcg

SEQ ID NO: 1598 - DNA, 305 bp, Homo sapiens
  ENST00000476327
ggcagcttattttggattggatcacaatgtggatcaaacaggaaaatctgttatcatcaacaagaccagcagcaccagaatgttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaat

SEQ ID NO: 1599 - DNA, 466 bp, Homo sapiens
  ENST00000494494
accagagcaaaggttttgtgaacatttaaaagatgaaaaaggtgaagaatcccagaagcggtttatcttgaagcgagataactctagtattgataaagaagacaatcagtcagtttgctcccaggaaagcctttttgtggaaaacaggtaaaataaaatttacttttccatgtctttagaggaacaacgtctgtcatgtgtgtcttgtgtattcataaatatatatcccatatatgtgtgtgcttgaatatatgtattagcagatacatatatctatgcgtacacacatatatgttatttaacacatctacaaatgatctaatttggaaaaaaaattttctttcagttaattccaaacagaattgtaaaactttttcttatttaaagtctcaatttctggtccttgcaaaggtatacttcctattaccttcaccaggcattaagaataataaatatggagacatca

SEQ ID NO: 1600 - DNA, 837 bp, Homo sapiens
  ENST00000481854
gagtttatcatcaccaggtaataatttcaggattgtggctttatggctctcccattcttaacgtggatcgcatggagtctgcacgctctgctttgatttgaaccctttcccttggcttctgttgtttggtggctgcagctctgcagctccagaagaaaccactagctcggaatccgacggccacacgtttctccagctgtttcattcacatttctcttcttctgacctccatgccgaacagactaaatctaaaacctggagacgtcctgaaggaaaaataccctatgctgcatgagaattgtttacttttctaatcctaaccaacctttttccttttttatttctatcttttgtacctatttttcttaattcttttcccctatgaggggaaagttagttttaaaatcaggcaagtatttgggatccctcagcatatccagaacttctgatccaatgccttttttttatttttcagtcagtttgctcccaggaaagcctttttgtggaaaacagtaggctcttggaagacagtaacatatgcaatgagacctataagaaaagacagctctttcggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcagg

SEQ ID NO: 1601 - DNA, 2014 bp, Homo sapiens
  ENST00000457165
gggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagtctgtccaggggctgcaggcttcctcccagtcagtgcaatatccagcagtctcttttcctccccagcacctcctacctgtgtctccaacgcagcactttcccatgagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgacctta

SEQ ID NO: 1602 - DNA, 647 bp, Homo sapiens
  ENST00000462173
gcttcctcccagtcagtgcaatatccagcagtctcttttcctccccagcacctcctacctgtgtctccaacgcagcactttcccatggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcagttgcagtgacaggtggatttctacagactgaatctgtggccatagtacttatttcaagataattggccaaggctaggttacatcctgtagccatgcaacagtgacagtaatttgatcacaataatgctgaccccatgacttttgacttcataattatcttgctgtagtcagctggccaacagcacttcatcaatgaaaatatccaccaggaggaatattatcatggggacagttattagagccacctccattttgactttgccccaagcttggtctggggaaaaagcttcttaaagttgcctcagcagtagtttgctgcctcccagcctggttttaagtatatccataattaacacgacgggtagaggtgcaagaa

SEQ ID NO: 1603 - DNA, 420 bp, Homo sapiens
  ENST00000463970
ttttgtatgtggctaggtacagttaactagaaaagggcctcaatacttttatcaaatctttgatgtgatccatatttctttataaatattaaatgtcagtgtccttgatcaataatttttcttagtagtgccctgttcttcccatttcaaagatgagtgagaaaactaagcagcagttcctaaactgaggactgaaggtttctgggagtttctgctgttaaagatagttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcatac

SEQ ID NO: 1604 - DNA, 407 bp, Homo sapiens
  ENST00000473138
aattattataaaatctgatttaagtgttgaccatagcctccagttccagccagctgaaaagataagcacatttgtatttgtgtggacaagtctgcagacttcttattgttgtctcaagccagacaatacaacccttttaaataacagttcctcataaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactg

SEQ ID NO: 1605 - DNA, 1104 bp, Homo sapiens
  ENST00000476052
tgaatttttaaagccataatcttgttcactcttagaagtaaaaaaaagagaaaatgcattcttagggaataaacatctgataacacattctgaatgtggagactgagatgtctgaaggctgccttttgaaccagtagttttaccccatgaaacatcactgtgttctttctgcacaaccagttcaaaagatctcttttcttcgcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactat

SEQ ID NO: 1606 - DNA, 3336 bp, Homo sapiens
  ENST00000420843
gggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcctgttgggagatcttgcatccagcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagctaccttgtatttcaagtgcatggccctgtctagagatatgcacagagagaaaagcagagggagggagggagggggtcttcagcaagcaccagcccccagcagagtgagctgaagctcctgaggagggttcccgaaggggggcgctcagagatgggggcagggggcggggagaggagagtctgccttatgtcccttccttgtggacttcacatggtcatgcaggaagtgaggatgggtgtccagcgggggccgaggccactagtatcctcctgcttccccctgccattctccagggctggactgaccctatggactgggagagagtgcctgaggccaccatgccacagtcaaagggggtcctatctcagaaggtggcagcatccactgagatatcctcacccgaagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagacaccctgaggtttacccaggcaaatatattgattagcaggacaagggctctctcctcagtttctgctcccttccatctctctcccatacttgtctgaaaagggagacaaaaaatcttatacaagtggcatctcaatcctttccagtccagcacctcctggggcaggcagtgtgacttatttcctgtggtgaaatcacctgtttcacaagcctggcagcgcgacttctgagtctcatgac

SEQ ID NO: 1607 - DNA, 1895 bp, Homo sapiens
  ENST00000360025
gggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgat

SEQ ID NO: 1608 - DNA, 701 bp, Homo sapiens
  ENST00000532447
gaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcgacgtggccgtggaactgcccttcaccctaatgcaccccaagcccaaagaggaacccccgcatcgggaagtgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcac

SEQ ID NO: 1609 - DNA, 1744 bp, Homo sapiens
  ENST00000531012
ttgtagcgatggggtcttgctatgttgcccaggctggtctcaaactcctagcctcaagcaatcctcctgtcagcctctcaagttgctgggattacaggcatgagcaactgtgcctgctgtggctgtactttttttttttttttttttgagatggagtcttgctctgtcacccaggctggagtgcagtggagcaatctcggctcactgtaagctccacctcccaggttcatgccattctcctggctcagcctcctgagtagctggaactacaggcgtccaccaccatgcccggctaatttttttgtatttttagtagagacggggtttcaccttgttagccaggatggtctccaactcctgacctcgtgatctacccgcctcggcctcccaaaatgctgggattacaggcgtgagccactgcacccggctggctgtaattctttaaataaatgtgctttttagcactgtgctgcttgactaggataatcttttagaatatccgagattcagtcctgtttgtgcgtagaatgtagatgtgcctcttttgagtggcagtggtctccttgcccgagctgggctggcccaagtggtccgtgtgtctgggggacagaggttgggagagggagacttggagcaggctcagactagatattctgctgggctggagatcagggctggggttggctctggggagggccatctccacagctgcttcctttcttcccagtgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcctgttgggagatcttgcatccaggtaaattcctcccttccacctggttcacccaccttcctggagggcctggagcccattggcttgactgaccagaatcacagggcactgggttggaaggaatcttagtggtcatttcagatagccaggttcaggtgtgagctgggagacacaatttctccttaacaaacctcaccttgctcttccatcccacctgagtgacagggatctttacagagagcaaagcctgattacactgatacagggagtggcccccaagagagctgtctgaattactgatcacctgaattataggagcttttggagaaatgcagacttcatggctttcaaacttctacactagtgaggagggaactgctggccaagtgttgctaaggagaggtcctcaggagatcctattttgtaaacaaggtctccttgcagccagctggatgcacttatattccaaaaatgcatgtaccccaaacacagcagtttggcctccttctgtcacaagatggcagtgtggctcatcctaagaaatcttaaactaatttgacaggtgaaattcattcaattcaattcagttccatatcattcagcaaagatttcctcaacccaggcttgcgtccaggctggtgctgagtgccagagtcccagagaggaatcagatgtggtccctgaccttatcgttcctggcccggtagaaggttaagatccagattcttccactaaaatgttggcaaacccagtcttccaccagctccattctgaagcaatccccaaagcaaaagg

SEQ ID NO: 1610 - DNA, 404 bp, Homo sapiens
  ENST00000529741
tgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcgggtgagtgctccagccaagcccaagaccccggagtgcagaggggagcgtcccaggtgcccacaggcccctgccccattctgcctgtttgcagcccttttagctgcatcca

SEQ ID NO: 1611 - DNA, 925 bp, Homo sapiens
  ENST00000532525
gggagagctgagcctgcggggctggccctggcctggctgctgctgcctgcagcccccagctcaggctccctccacctcacagtccactgctttggcgctgcttctgggctggcctcttcactccactgaatctttgggctctcatctgtaaaatgggagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggc

SEQ ID NO: 1612 - DNA, 593 bp, Homo sapiens
  ENST00000524400
gtggaggaaggagaagggagaggccagcagcagccactgcaagagatgggagaggagaggccatggaaggagacttgcagcgggagaggctgagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacag

SEQ ID NO: 1613 - DNA, 559 bp, Homo sapiens
  ENST00000533609
agccactgcaagagatgggagaggagaggccatggaaggagacttgcagcgggagaggctgagagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcag

SEQ ID NO: 1614 - DNA, 563 bp, Homo sapiens
  ENST00000527385
gtgtctgccttccgctgccctgtaggtgctctggggaaacaacaccgacaccggggcctgtaccttctgcagagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaagg

SEQ ID NO: 1615 - DNA, 308 bp, Homo sapiens
  ENST00000530086
gtcccctggggcccttggtctgatgggtgtatgggagtgtctgggctgcaatacatgagacaggacagtggtggatgtgacaggtggctcgttctgtcctcttcttgacagatccctccaaaccttccatgttctgtgacactgcagccggggcccgaagacacggggaaggcttgcggtgtggactatgaagtcaaagccttctgcgcggagaatttggaggagaagatccacaagcggtgagtaggatgccagggtgtgggccgcctgctgggtgagggagggagacaggatgggcaaagtccaag

SEQ ID NO: 1616 - DNA, 684 bp, Homo sapiens
  ENST00000529280
gggagaggccgcttactctctgtcctttccccagatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggtaggtcaccccaaggggaccatctctctggctccaggagtctcatgtccccaggtccctggctttctccctgggaggtgctggacacacaggaccactctccctgttgaacagtctttgtgtctaggctaagctggtcccaccttggacaaccagtctctcttcagacagggcagcaggtacggggtcagcctcactctcccattcagtgatgggtctggaggctctcctgggtggcgttggctgcaacaggaccaaagtgttctgaggacctacacctggcctcatgtaacccctggcaacctggaatcaaagtgcgatcatccccatttcacagatggggaaact

SEQ ID NO: 1617 - DNA, 551 bp, Homo sapiens
  ENST00000533255
attttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggtaggtcaccccaaggggaccatctctctggctccaggagtctcatgtccccaggtccctggctttctccctgggaggtgctgg

SEQ ID NO: 1618 - DNA, 4188 bp, Homo sapiens
  ENST00000265138
acaaagctgctcttaaagtgagctggcagcttttagccgcccgtctttgtaaggagaccactgagacgagcgggagcgcggagcagcagcctctgctgccctgactttttaagaaatctcaatgaactatttgtagagaatcactgatccggcctgcaagcattttgcacggcaaaaatatcgatcagtgttaagtgaagatcacattttatatgcgatcttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcatgcaagaggacatgcgaaagtacgctggactgaatctagaaacgccggctccaatactgcctatacacagaattacactgaagaagtagagtatttcaaccataaagacatcttaattgggcacgaaagagatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaaacacaggccttctatgccaaagggaaaatgaaggaagtaaaacagcttgtggctaacttgcgtggggaatccttatcatctggaaagacagagacgtggaatggcaagttgctgaaaattccaccagtttctccctctatcctcgactgtagtataatccgcgtggaatattcactaatggtatatgtggatattcctggagctatggatttatttcttaatttgccacttgtcatcggtaccattcctctacatccatttggtagcagaacctcaagtgtaagcagtcagtgtagcatgaatatgaactggctcagtttatcacttcctgaaagacctgaagcaccacccagctatgcagaagtggtaacagaggaacaaaggcggaacaatcttgcaccagtgagtgcttgtgatgactttgagagagcccttcaaggaccactgtttgcatatatccaggagtttcgattcttgcctccacctctttattcagagattgatccaaatcctgatcagtcagcagatgatagaccatcctgcccctctcgttgaaggaacacttggttgaatcaagttgatgtgggttccgaactgtatctcttccggctgaggacagagaagtatcttggagacacgtttcagaggaagtggaattacttttgcccagaaaaatggcgaatacatgaaacaaccagtgatcatgctttagaagcctacagcaacattctgagactgctccaacatgcttgaagatctaagcttttctcttttaaaactggcacatactcagagcagtcttcttagcctatggtcgtacgtgtcaagacatcacgttgtaaagagggatgatttccttcttttgatttgaaaatttgcacatgctcaatgcttacattgtgcggttcgacgtcactacagcttctttttttttttttttttttttctatttttgccagactcttgatactcttaaaacttgtttgtggtcagcacaacaaggaacaaaacaaagctttgaaaaaactttaacatgaaaaaacgcactgacatttttttttatttaatatagcctggactttacctgcgtatgcacatgctcagaattgtctactaggctgactatgtatcacctcttcagcttggatccaattgtggatttatttacaaacatcaaatgccttcaagccaatcctttttgctgtatgttttgcagcctactgtagtagatacgcaacagataatgtgggaaaaaaagagataagaggaggaagctaataagagactgtcaagattgtataccttcttggtttcttttaagaatttgttgcctttctactattacagcaaagcagcattttgttactgactgcctaaaatcacttaatctcaggtgaacgcatcacttgccaaactgttggaatgctatttgtgttttgttgcactgtttttttcgtttgtttgtttgtttatttggttggctttttggagagggaaatttggaaacgggacatacacaaaagttacacacccacattccctttttatcatgacatacaagaagaaactagcagagctaagaatggagtgaagaaaggcagtatggcaggcaccagcaaagagttgagggctgttgctcttaaaaattattttttttattattattttgaaagtatggaagttttccattcactggggaaaggagggaaaagtgcatttatttttatacagagttacttaattacctccaaaacacatatgttggaaatcgcttttgctggtgcaaagtatattaatgagcaggaatacatacattgaggttatgaatagagagctcaatttgtacctttgctgtcttgctcaagcttggtatggcatgaaaactcgactttattccaaaagtaacttcaaaatttaaaatactagaacgtttgctgcgataaatcttttggatttttgtgtttttctaatgagaatactgtttttcattacctaaagaacaatttgctaaacatgagaaatcactcactttgattatgtatagattacataggaagaacaatcacatcagtaagttatagtttatattaaaggtaattttctgttggctcataacaaatataccagcattcatgatagcatttcagcattttccaaggtaccaagtgtacttattttgttgttgttgttgttgttgtattttagaaggaattcagctctgatgtttttaaagaaaaccagcatctctgatgttgcaacatacgtgtaaaatgggtgttacatctatcctgccatttaaccccacagttaataaagtggctgaaaataatagtagctctggcttggtgcttgacctggttaaatactgtcttaaagctcatacaaaacaaataggcttttccataagtggcctttaagaaaacatggaagacaattcatgtttgacaaatgctgacagggtgaagaaagcccagtgtaaaaatgaatcgcgttttaagtgattcggttaaagagtttgggctcccgtagcaaactaatactagataataaggaaatgggggtgaaatatttttttattgttgaatcattttgtgaatgtccccctcaaaaaaagctaatggaatatttggcataaagggcatttggtggttttatttttgtttgagggggattgtcagaaaatcccttttctctcttacgtctaactgactagggaacaattgttgatatgcatagcattggaatacttgtcattatatactcttacaaataacacatgaagcaagaatgaccaatattctgataattggcactggatcacaaaatgtgataaaactttaaatgtataaaactttatcaaataaagttttattttcccctttaaaatgtatttctttagaggcattacttttttaaaaatattggtcaattcctgacataagatgtgaggttcacagttgtattccagtattcaagatagattcctgatttttcaattaggaaaagtaaaatccaaaatgttagcaaaacaaagtgcaatattaaatgtttgctttatagattatattctatggctgtttgtaatttctctttttttccttttttatttggtgctgaatatgtccttgtaggctctgttttaagaaaacaatatgtgggaaatgatttaatttttcctattgctcttccttgtggaaaataaagtgttttgtttttttctgttttgtataa

SEQ ID NO: 1619 - DNA, 821 bp, Homo sapiens
  ENST00000511391
ccttcagcaccacccagctatgcagaagtggtaacagaggaacaaaggcggaacaatcttgcaccagtgagtgcttgtgatgactttgagagagcccttcaaggaccactgtttgcatatatccaggagtttcgattcttgcctccacctctttattcagagattgatccaaatcctgatcagtcagcagatgatagaccatcctgcccctctcgttgaaggaacacttggttgaatcaagttgatgtgggttccgaactgtatctcttccggctgaggacagagaagtatcttggagacacgtttcagaggaagtggaattacttttgcccagaaaaatggcgaatacatgaaacaaccagtgatcatgctttagaagcctacagcaacattctgagactgctccaacatgcttgaagatctaagcttttctcttttaaaactggcacatactcagagcagtcttcttagcctatggtcgtacgtgtcaagacatcacgttgtaaagagggatgatttccttcttttgatttgaaaatttgcacatgctcaatgcttacattgtgcggttcgacgtcactacagcttctttttttttttttttttttttctatttttgccagactcttgatactcttaaaacttgtttgtggtcagcacaacaaggaacaaaacaaagctttgaaaaaactttaacatgaaaaaacgcactgacatttttttttatttaatatagcctggactttacctgcgtatgcacatgctcagaattgtctactaggctgactatgtatcacctcttcagcttggatccaattgtg

SEQ ID NO: 1620 - DNA, 475 bp, Homo sapiens
  ENST00000505631
tcaaatagctactgattagttcatttctatgactcaagttatttgcagttcctgggacatcttttcatgtatgttagttgcactttcttactttagctttaagaatcttgacttcttttgttgtttttttctaacagtagatatgtatatatttttccctctctaggtgaatcaattcagatatttgctgagattgagaactgctcttcccgaatggtggtgccaaaggcagccatttaccaaacacaggccttctatgccaaagggaaaatgaaggaagtaaaacagcttgtggctaacttgcgtggggaatccttatcatctggaaagacagagacgtggaatggcaagttgctgaaaattccaccagtttctccctctatcctcgactgtagtataatccgcgtggaatattcactaatggtatatgtggatattcctggagctatggatttatttcttaatttgccacttg

SEQ ID NO: 1621 - DNA, 531 bp, Homo sapiens
  ENST00000514284
gagactgctgagctggcacaaaaagggagcgaagagggaagaaagggaaaggaaggcgaacttcgggcgccttcgaggggagcgaatttaaatggcccccagctcatcagctagtttttggttctgaaatccgttcaggggaatttgcacaggggacgaggaaaattatgatgataattccgaagaaggcttccacactattcattcaggaaggcatgaatatgcattcagcttcgagcttccacagactcaccccaagcaggcacaaaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaaacacaggccttctatgccaaagggaaaatgaaggaagtaaaacagcttgtggctaacttgcgtggggaatccttatcatctggaaagacagagacgtggaat

SEQ ID NO: 1622 - DNA, 564 bp, Homo sapiens
  ENST00000508948
gagagtgagctcgcgccgcggctggggcgaggctaggaaaccggcgtgcgccggtaaaggttcctccagagcgacccccacccagcccgtactcacgtttgttcccgggcttctgggggcgcccagcccgtgtcaacatcatgttctgtcgcccctcttttgggcctcctaagggccatcgaaaggaaacgacttcaggctttaactgagtagagggcagacgctcctgccggccttacagatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggc

SEQ ID NO: 1623 - DNA, 587 bp, Homo sapiens
  ENST00000503192
agttcttgattgacagcccggcacttgtttaccacggcgcggccgccgccgctcgcttcaatgagactgctgagctggcacaaaaagggagcgaagagggaagaaagggaaaggaaggcgaacttcgggcgccttcgaggggagcgaatttaaatggcccccagctcatcagctagtttttggttctgaaatccgttcaggggaatttgcacaggggacgaggaaaattgtatggagacataagcgaatcaccatgatttttaaatgaaaatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaagg

SEQ ID NO: 1624 - DNA, 355 bp, Homo sapiens
  ENST00000507075
agaattacactgaagaagtagagtatttcaaccataaagacatcttaattgggcacgaaagagatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactggtaagaattgactgaattatttattctttgtttttggcatataaatattaaagaataatcaa

SEQ ID NO: 1625 - DNA, 1215 bp, Homo sapiens
  ENST00000443820
atgcgatcagccagcttgagtggacgcacccgcccgccgccagggaatctttgccggtgctactgtttttatgcttgcttctgaagacgtgtgaacctaaaactgcaaatgcctttaaaccaaatatcctactgatcatggcggatgatctaggcattggggatctcggttgctatgggaacaatacactgagaatgccaaatattgaccagcttgcagaggaaggtgtgaggctcactcagcacctggcggccaccctgctctgcaccccaagccgagctgcattcctcatggggagacattctttcaggtcaggcatggacgccagcaatggatactgggcccttcagtggaatgcaggctcaggtggctccctgagaacgaaaccacttttgcaagaatcttgcagcaccgcgactatgcaactggcctcataagtaagattcttaatgccatcgaagacaatgatttaagaaactcaacattcacgtatttcacctctgaccatggaggacatttagaggcaagagatggacacaggagttagggggatggaacagaatttacaaaggtgggaagggcataggaggatgggaagatgggatccatgtgcccgggattttccactggcccagggtgctcctggctggctgagtgattggagagcccacgagcctgatggacgtgttccctcctgtggtccagctggcaggcggcaaggtgccccaggacagggtgatcgacaaccgcagcttggtgcccttgctgcagggagctgaggcatgcttagcacatgagttcctgtttcattactgtgggtagcatctccacacagcacactggcaactgaaggacagtggaagcatctggaaggttcattacgtgatcccacagttccaccccatgggagcaggggcctgctacagctgaggcatctgcccatgctccagggagggcatgacccatcacagaccccctttgctctttgacctctccacggaccactctgaggcacagcccctgacccctgactccaagcacctgtaccacgccatgatagcaagggtaggtgccgcagtgtcgaagcattggcagaccctgagtcctgtgccccagcagttttccacaagcaacatcttgtggaagctgtggctgcagccgtgctgcagacatttcccgttctgctcatgcccaaggatggggatggcaccccga

SEQ ID NO: 1626 - DNA, 4642 bp, Homo sapiens
  ENST00000448504
ggctgcgcccaggccggcgggcccagcagctgcgaaccgccggcgcaccacctgtttccgcgcccggggacttccccggcggggctcagaagtgtgggatcggtcgcttggcttcccctggcgtcagcgacccagggtaacctcctccactgctgcgtgccgtgcaggcctgcctgtgtgagagccacgtgtgccgcgctctgggcacagccttggaaagtcaggaccgcgacggcagcagagcagaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataaaggcatacatgaaaatgcctggcaaattacctgacacagagcagacattcaatacattttagtttccttgtttctctggttcccagtttctctggtcattttggtgtaaatccattctaattagtatttagggcagagcttctctctcttttctctttttttccttccacaaaccagtgtactcactggtctccatctttaatatgcaaacaaatcacctgggatcttgtgagaatccggattccgtctcagtagggctcgagtagatcctgaaatcctacatttctatcaaacaatgccttgaggagcacagatttagaccaaagttaggtcgttttccagatctcagagcagacgagtccatggataagtctgtggcccaatccccttcctctccttttaagggtgaaatgactgcatttaaaagaagttaaagagttcctcctgtcccctataaccacaaggaaacaaaaaaatatataaaaacctcaaaaatgcattgccatgattttattattagtgtccaaaatgggactcccaagtaataaatgatttattccagccacagccaaaaaagactttgcctggctaaaagagtctctctctaagtatgtaatatacaagaaatacaattcaaagagatgttcctataagtacattttttacacggcatatatttaaaaaggaggccccttttaatataaaattccggttatataccaatatggttaattagcatttacactatagtttgaacgtattttaaatagcatgatgtgtatacaatgtctcccgcgcccattggcaaccagggtcgtgggaagcttggtgaggagttaaccaggtcctgtggtttaagcagtggagcacccgggattcctgcccccctttctgctcacacaattgcactccattcttccgccttccttgttttctccaaaaccacctgataggggggatgtcctgatttctgaggtgtgcttctcatcatgactgcttcgttttgcccttctgatttccacggcacaagattatctaccaaaatcaaaacagaatggccttactcttctcaggaagaggctggtaggcaggtgcattatcaacaggtctgtgcccatgcagagtgagcagggagaggctgggcactgtggaatttttctgtctgaactcgctcatggccacagaatggtcacccagcttatttaggtgtagacaagtatgacacagttctagaaaatactgactataaaaatgtctctgtgtgtgtgtgtatgtatttatatgtatatgtatatatttttaaaaggctcatcttacttgtaaacatggactgctcaatcactattaaaaagtcagtttaggctgggcgcggtggctcacgcctgtaatcccagaactttgggaggctgaggtgggtggatcactaggtcaggagtttgagaccagcctggccaacatggtgaaaccccatcgctactaaaaaatacaaaaattagccgggcatggtggcgctcacctgtaatcccagctactcgggaggctgaggcaggagagaatcgcttgaaccggggaggtggaggctgcagtgagccgagatcgcaccactgcactccagcctgggcgatggagcaagactccatctcaaaaaaaaaaaagtcagtttaggctgggcgcagtggctcacacctgtaatcccagcactttaggaggctgaggggggtgatcacctgaggtcaggagtttgagaccagcctggccaacatggtgaaatcctgtctctactaaaaatacaaaatttagctgggcatggtagcatgcctgaaaccccagctacttgggaggctgaggcactagaatcacttgaacctaggaggtggaggttgcagtgagtggagatcacgccaacacattctagcctgagggacagagtgagactctatcatctc

SEQ ID NO: 1627 - DNA, 701 bp, Homo sapiens
  ENST00000578726
gtcaggaccgcgacggcagcagagcatgtctagacaacttctgagccaaagaggaacacttaccagagatgatgccgatggcgacgtacatatgagaaacctcttgtgagaaggaggcggccaccatcccggtgctgacaagtagcccccccaacatcactaccagacggtgtccgaaacgattgctcaggactgtggcgaggggagctgccgggaaagaacaaaacgatattttaactcacagaggcttcagggttagctgccataagactccttcctccacgtcttgcacatggagagatgatgtcgaatataaatatggccgagcgcagtggctcatgcctgtaatcccagcactttgggaggttgaggacggaggatcgcttgagcccaggagttcaagactagcccgggcaacatggtgaaaccccgtctctacaaaaaatacaaaaattagccaggcatggtggtgtgcacctgtagtcccagctacttggcaggcagagatgggaggattgtttgagcctgggaggcagacgatgcagtgagccaagattgcaccactgcactccatactgggtgacagagtgagaccctgtctcaagaaaaaacaaaaccaaaccataacacatttcatgcaaagtcagtgcaggaattattttactatttgttcaaattcaacacgatttgtcagactcctg

SEQ ID NO: 1628 - DNA, 715 bp, Homo sapiens
  ENST00000581639
gcgcgccgtcccacgtggacctgagccgcgccggtcgcgcgcccgccagcctgccgcctgggctgggggtcacgaaaggaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgg

SEQ ID NO: 1629 - DNA, 1733 bp, Homo sapiens
  ENST00000452479
gcgccggtcgcgcgcccgccagcctgccgcctgggctgggggtcacgaaaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataa

SEQ ID NO: 1630 - DNA, 1398 bp, Homo sapiens
  ENST00000582154
accctgggcctcctggtgcctttgcagggccccagcgcgggagggcaaagtgaaggagcccatgtggggttgctgtgtctgtggagccctctttgaggggcagaggctcaggcttctccgggctcctggtgatgggctgtcttcccctttcactgtggtttcccgcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatt

SEQ ID NO: 1631 - DNA, 577 bp, Homo sapiens
  ENST00000581032
cacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaaggagattccactcctcaagggcaatggactccaagaaacttggtgttttctacagccttagcctaagtggtcaagaaagcacgtgctgcacggctgtccacttgggcagaattaaaaagggactctacctgtggctaagtgatcacagcagccccttgaatatgcaggaatcccccacccctcgctcagccacattggacgtttttagaagctcagcagggagggttgaggcagcaatgcaggagatccaggcatcctgttttcttggtaataaaacctatttaaggattgaatctcaaa

SEQ ID NO: 1632 - DNA, 979 bp, Homo sapiens
  ENST00000578554
atgtaagtgcctttccagccctatatacggttgtgattcataccaaggcagtctcatgcttttagcccagacccaccaacctaccaaggacactggccttttgttttctttcacatccttccctcgagaaccctgatttaggtgtttccattctgtacggtaattcttttatttgtgacctgatgaggaaagatttcctcagtccaaatatagtcggattgagtcatagctgtgggcgtctgtgaccagagtctgggctgtgcccgattctgcggaaatcaaggatgccttcttttgtaccatccttgctcaagggagagttggaacattgacttgatgctgaagaagcctttcttcaaagacagctgagggtcacctgcatcagaacccttggaaatacttgtaaaacaagtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggca

SEQ ID NO: 1633 - DNA, 791 bp, Homo sapiens
  ENST00000590690
gagacaggatcttgctctatcacccaggctggagtgcagtggtatgatcatagctcactgcagcgttgacctcccaggctcaaacaatcctctcacctcagcttccaagtagctaggaccacaggtgtgcaccaccatgcctggttaacttttgtatttttttgtagggaggggtcttgctgtgttgcccaggctggtttcaaactcctgggctcaagtgatcctcctgcctcgacctcccaaggtattgggattacaggcatgagtcaccgagttctgccaatttttctattagtaagctctgccaccctttctcaggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttgg

SEQ ID NO: 1634 - DNA, 2599 bp, Homo sapiens
  ENST00000621439
gccgtcccacgtggacctgagccgcgccggtcgcgcgcccgccagcctgccgcctgggctgggggtcacgaaaggaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataaaggcatacatgaaaatgcctggcaaattacctgacacagagcagacattcaatacattttagtttccttgtttc

SEQ ID NO: 1635 - DNA, 2876 bp, Homo sapiens
  ENST00000379044
ttgtcctgagcgcggagagggcgagctcgggccgcgggcagggcgggagccggcagccggcaaccaagggaggcagaaaggcacaaagatcgcaataatatccgttataacccgctatctaaccccacccccaacacacacccatccatcccaccctccgggagaggcagccggcgatccgctctctgcgccctgggaaaaagccccagccatgagcaatcagtaccaggaggagggctgctccgagaggcccgagtgcaaaagtaaatctccaactttgctctcctcctactgcatcgacagcatcctgggccggaggagcccgtgcaaaatgcggttgctgggagccgcgcagagcttgcctgctccgctgaccagccgcgccgacccggaaaaggccgtgcaaggctcccctaagagcagcagcgccccgttcgaggccgagctgcacctgccgcccaagctgcggcgcctgtacggcccgggcgggggccgcctccttcagggtgcggcagcggcggcggcggcggcggcggcggcggcggcagcggccgccacggccacggcgggtccacgcggggaggcccctccgccgccaccgccaaccgcgcggcccggggaacggccggacggcgcaggggccgccgcggcagccgcggccgcggccgccgcggcctgggacacgctcaagatcagccaggcgccgcaggtgagcatcagccgcagcaagtcgtaccgcgagaacggggcgcccttcgtgccgccgccgcccgcgctggacgagctgggcggcccggggggcgtcacgcacccggaggagcgcctcggcgtggccggcggcccgggcagcgccccggctgcgggtggtggcaccggcaccgaggacgacgaggaggagctgctggaggacgaagaagatgaggacgaggaagaggaactgctggaggacgacgaggaggagctgctggaggacgacgcccgcgcgctgctcaaggagccccggcgctgtcctgtggccgccactggcgccgtggccgcagcagctgccgctgcagtggccacagagggcggggagctgtcacccaaggaggagctgctgctgcacccggaagacgctgagggcaaggacggcgaggacagcgtgtgcctctctgcgggcagcgactcggaggaggggctgctgaaacgcaaacagaggcgctaccgcaccacgttcaccagctaccagctggaggaactggagcgggccttccagaagacgcactacccggacgtcttcaccagggaggaactggccatgaggctggacttgaccgaggcccgagtccaggtctggttccagaaccgtcgggccaagtggcgcaagcgggagaaggcaggcgcgcagacccacccccctgggctgcccttcccggggccgctctccgccacccacccgctcagcccctacctggacgccagccccttccctccgcaccacccggcgctcgactccgcttggactgccgctgccgccgccgccgccgccgccttcccgagcctacctccgcctccgggctcggccagcctgccgcccagcggggcgccgctgggcctgagcactttcctcggagcggcagtgttccgacacccagctttcatcagcccggcattcggcaggctcttttccacaatggcccccctgaccagcgcgtcgaccgcggccgcgctcctgagacagcccacacccgccgtggagggcgcagtggcatcgggcgccctggccgacccggccacggcggccgcagacagacgcgcctctagcatagccgcgctgaggctcaaggccaaggagcacgcggcgcagctcacgcagctcaacatcctgccgggcaccagcacgggcaaggaggtgtgctaaaggctgccctccacacccgcgccccgcgcgcgccccgaaaggtcacctcactcagcaccactcaagaccaaatggaaacagaggaccagcacactcccgagacggcactgagagagcgcagccgccttcacagcagtctggatgcgggcatggcagccctcggcgctccgggacgtggcacctcctcggctggctgtccacccgcccctgcccctgcccctgctactgccaacctcgctccaactccaacatccactctctcttgttcttactttcctgaaaatatcggggaggttttctcccccagacgcctgatattgaagtaaaaaatttaaaaagcccaacctcttcctcctgacaccccacttagcctttcttttctttctttctttctttcttttttttttttaaatagcattttggcgctcgaagttgatctccccagcgagggccccagcgtgaagccagggcccgggaagcaaatgcgagcctgtaagatagctaacagtgcacttaaaggaaaggggcgtcttgttcttgttctcttctttatcatacaccaaccaaggtttttatatcaaaccaaagggaaataatactctgctagaatatggactgttgaagtcaccaaactgtgattattgattctgtacataccattgttattaaaaaaaaaaaaaaaagaacagagctttgtatatttgaaatgttataacgcaattgcactcagcgtggtatggtaaaagtttgtcctcccgtagattcttactgtgttgtagatacggtagggttcctagacaaatatttatgtactcaagccctttatttaacttattaactgtagaggcttccgaaaccttcaagataaaggcaatggtacagtacttttgtgtaatgtgtaattgttaccacttttccttgctatctagtggagaagtgtcacgctcaaaataaaaaaattatatgtttaacaaaa

SEQ ID NO: 1636 - DNA, 87 bp, Homo sapiens
  ENST00000636885
ggcttgggagaaggaggcggcgctcggtgagcccaggctcttttccacaatggcccccctgaccagcgcgtcgaccgcggccgcgct

SEQ ID NO: 1637 - DNA, 144 bp, Homo sapiens
  ENST00000637993
gcactttcctcggagcggcagtgttccgacacccagctttcatcagcccggcattcggcagactccatcttccttgtcactcaagtgacccgctgccaacgacacccccatatgtgcaagccccgatctacacggcagtacaag

SEQ ID NO: 1638 - DNA, 100 bp, Homo sapiens
  ENST00000636609
agctgcaggaagaggatagcggacttagaaaattgcatcctgggccggaggagcccgtgcaaaatgcggttgctgggagccgcgcagagcttgcctgctc

SEQ ID NO: 1639 - DNA, 100 bp, Homo sapiens
  ENST00000637394
gcaattgagcgccagggaggtcaaggcggtgtcctgggagcccaatatcggctttgaaaagtgccgacatcctgggccggaggagcccgtgcaaaatgcg

SEQ ID NO: 1640 - DNA, 2552 bp, Homo sapiens
  ENST00000495646
cgtctattttcctacgactccagctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttaggactgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacaattgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcagggttgatggatgcccacttctcttctctttctcttggtcaactcaggagccttttagtctgagggaatggagaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagtt

SEQ ID NO: 1641 - DNA, 4050 bp, Homo sapiens
  ENST00000336689
gtgccccccgcgccccgctccggcagctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatccctggggaggtggcccaggacatgcagagagagcggcgcatcttccagctgcacatgtgtgagtatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggaacacctgagccggaagaactcaggatgtggctatagcatccaccagcaccaaggcaacaagcagtttgggacggagaaagtgggctttctatacaagaaaagtgacggaattcgaagagtctggcagaaaaggaagtgtggagtcaagtatggctgcctgaccatctcacacagcacgataaaccggcccccggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttaggactgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacaattgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcagggttgatggatgcccacttctcttctctttctcttggtcaactcaggagccttttagtctgagggaatggagaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagtt

SEQ ID NO: 1642 - DNA, 936 bp, Homo sapiens
  ENST00000465372
ctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagaatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttaggactgatggcggttctttcctatctcattacccgctaggggcctgggagccctgtggctggatctgagtgctcctgagctggcttcagctgcagaactctcagtccctcatcagatcgagactctatttccc

SEQ ID NO: 1643 - DNA, 3024 bp, Homo sapiens
  ENST00000492982
agctcagtgccccccgcgccccgctccggcagctccacgctcgcgcccgccatgccggagcagttcagcgtcgccgagttcctggccgtcaccgcggaggacctcagctccccggctggggccgccgccttcgccgccaagatgccccgatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatccctggggaggtggcccaggacatgcagagagagcggcgcatcttccagctgcacatgtgtgagtatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggaacacctgagccggaagaactcaggatgtggctatagcatccaccagcaccaaggcaacaagcagtttgggacggagaaagtgggctttctatacaagaaaagtgacggaattcgaagagtctggcagaaaaggaagtgtggagtcaagtatggctgcctgaccatctcacacagcacgataaaccggcccccggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaaggtgggtcccagccctgtccctcaggcctctggatggcagaaggaaagagccagattgggcctgcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttaggactgatggcggttctttcctatctcattacccgcta

SEQ ID NO: 1644 - DNA, 2865 bp, Homo sapiens
  ENST00000437606
agtgccccccgcgccccgctccggcagctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggcttctctttccttggggtctagggccaagctggagaaggagcgcgatcgggccagggtgacaggagggatccctggggaggtggcccaggacatgcagagagagcggcgcatcttccagctgcacatgtgtgagtatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggaacacctgagccggaagaactcaggatgtggctatagcatccaccagcaccaaggcaacaagcagtttgggacggagaaagtgggctttctatacaagaaaagtgacggaattcgaagagtctggcagaaaaggaagtgtggagtcaagtatggctgcctgaccatctcacacagcacgataaaccggcccccggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctg

SEQ ID NO: 1645 - DNA, 907 bp, Homo sapiens
  ENST00000484418
gcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggtgagaacccctccaagggccacttataacccacctgtctaacatattccccagttcttctccaggaccagctgttactcccctccaccccacctctgacatctgctcagatctcacccatcagagtggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacct

SEQ ID NO: 1646 - DNA, 805 bp, Homo sapiens
  ENST00000475814
tatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggaacacctgagccggaagaactcaggatgtggctatagcatccaccagcaccaaggcaacaagcagtttgggacggagaaagtgggctttctatacaagaaaagtgacggataaaccggcccccggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctggg

SEQ ID NO: 1647 - DNA, 591 bp, Homo sapiens
  ENST00000530874
gggacctgaaggccccaatctagtcttagtctacacttcacatccttgaggtgctgctgggtgaggagaaacacaaatggaacaggatgattatgcccatttaacagagtgggaaatggaggcctaaagaatgtggagggccagaggtaatgcatacatcctccgcccctaaattcccacagataaaccggcccccggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgct

SEQ ID NO: 1648 - DNA, 888 bp, Homo sapiens
  ENST00000478858
cgcggagcagctcagtgccccccgcgccccgctccggcagctccacgctcgcgcccgccatgccggagcagttcagcgtcgccgagttcctggccgtcaccgcggaggacctcagctccccggctggggccgccgccttcgccgccaagatgccccgatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatccctggggaggtggcccaggacatgcagagagagcggcgcatcttccagctgcacatgtgtgagtatctgctcaaagccggggagagccagatgaagcaaggtcctgacttccttcagagcctcatcaagttcttccacgcccagcacaaatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggtcagcccctgaactatcccaaaaggaatgccctccc

SEQ ID NO: 1649 - DNA, 589 bp, Homo sapiens
  ENST00000608765
gaggaggatttggaagacccagagcgggatgaaacgggacagagccctgaaggggcagggatgggggaaggcggaggagtttctactgaggccagggctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaat

SEQ ID NO: 1650 - DNA, 480 bp, Homo sapiens
  ENST00000449467
attattattttattttttgagacagggtctcactctgtcacccaggctagagtacagtggcacaatcatggctcaccacagcctcaacctcctgggctcaggtgattttcccacctcagcctcctgagtagctaggattactggcgccggcttaatttttgtattttttgtagggttggggtttcactatgttgcccggctggtcttgaactcctgggctcaagtgatctgcccacctcagcctccaaaaatgttaggattacaggcgtgagccactatgctcggccagggcataatttgtaataagtaatttaaaacataacagaaaaggcctatgaacaactatctcaatccctgtattctccccagagatcttggaaggagaccaagccatcctgcagagaataaagaaggctgtgcgggcaatccatagctccggccttggccatgtggagaatgaagagcagtaccgagaggccg

SEQ ID NO: 1651 - DNA, 2226 bp, Homo sapiens
  ENST00000618240
aggatttggaagacccagagcgggatgaaacgggacagagccctgaaggggcagggatgggggaaggcggaggagtttctactgaggccagggctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatccctgggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttaggactgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacaattgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcagggttgatggatgcccacttctcttctctttctcttggtcaactcaggagccttttagtctgagggaatggagaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagtt

SEQ ID NO: 1652 - DNA, 2552 bp, Homo sapiens; identical to SEQ ID NO: 1640
  ENST00000634513

SEQ ID NO: 1653 - DNA, 4050 bp, Homo sapiens; identical to SEQ ID NO: 1641
  ENST00000634561

SEQ ID NO: 1654 - DNA, 2226 bp, Homo sapiens; identical to SEQ ID NO: 1651
  ENST00000635693

SEQ ID NO: 1655 - DNA, 936 bp, Homo sapiens; identical to SEQ ID NO: 1642
  ENST00000635461

SEQ ID NO: 1656 - DNA, 3024 bp, Homo sapiens; identical to SEQ ID NO: 1643
  ENST00000634705

SEQ ID NO: 1657 - DNA, 2865 bp, Homo sapiens; identical to SEQ ID NO: 1644
  ENST00000635198

SEQ ID NO: 1658 - DNA, 907 bp, Homo sapiens; identical to SEQ ID NO: 1645
  ENST00000635167

SEQ ID NO: 1659 - DNA, 805 bp, Homo sapiens; identical to SEQ ID NO: 1646
  ENST00000634883

SEQ ID NO: 1660 - DNA, 591 bp, Homo sapiens; identical to SEQ ID NO: 1647
  ENST00000635442

SEQ ID NO: 1661 - DNA, 888 bp, Homo sapiens; identical to SEQ ID NO: 1648
  ENST00000634459

SEQ ID NO: 1662 - DNA, 589 bp, Homo sapiens; identical to SEQ ID NO: 1649
  ENST00000634548

SEQ ID NO: 1663 - DNA, 480 bp, Homo sapiens; identical to SEQ ID NO: 1650
  ENST00000635351

SEQ ID NO: 1664 - DNA, 2472 bp, Homo sapiens
  ENST00000266744
cttctggccagggaacgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggatcgctctgattccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcagggtgatcgcacaacctgcatctttagtgctttcttgtcagtggcgttgggagggggagaaaaggaaaagaaaaaaaaaagaagaagaagaagaaaagagaagaagaaaaaaacgaaaacagtcaaccaaccccatcgccaactaagcgaggcatgcctgagagacatggctttcagaaaacgggaagcgctcagaacagtatctttgcactccaatcattcacggagatatgaagagcaactgggacctgagtcaatgcgcaaaatgcagcttgtgtgcaaaagcagtgggctcctggcagaagggagcagcacacgcgttatagtaactcccatcacctctaacacgcacagctgaaagttcttgctcgggtcccttcacctcctcgccctttcttaaagtgcagttcttagccctctagaaacgagttggtgtctttcgtctcagtagcccccaccccaataagctgtagacattggtttacagtgaaactatgctattctcagccctttgaaactctgcttctcctccagggcccgattcccaaaccccatggcttccctcacactgtcttttctaccattttcattatagaatgcttccaatcttttgtgaattttttattataaaaaatctatttgtatctatcctaaccagttcggggatatattaagatatttttgtacataagagagaaagagagagaaaaatttatagaagttttgtacaaatggtttaaaatgtgtatatcttgatactttaacatgtaatgctattacctctgcatattttagatgtgtagttcaccttacaactgcaattttccctatgtggttttgtaaagaactctcctcataggtgagatcaagaggccaccagttgtacttcagcaccaatgtgtcttactttatagaaatgttgttaatgtattaatgatgttattaaatactgttcaagaagaacaaagtttatgcagctactgtccaaactcaaagtggcagccagttggttttgataggttgccttttggagatttctattactgcctttttttttcttactgttttattacaaacttacaaaaatatgtataaccctgttttatacaaactagtttcgtaataaaactttttcctttttttaaaatgaaaataa

SEQ ID NO: 1665 - DNA, 1504 bp, Homo sapiens
  ENST00000269299
cccaaacggtgcacggaagagtgaggtgactggcatgtgtgggggcaacacgattctcctccctggggagcagagcagaggcaacccatcccccactcccacccccacactcccctaagttccaatccatttccacctctgtttactgtccaaagtcccgggcactggagatgccacgtttggcgtgcttggacacacagacacgcagacacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaactttttttttttaagagtaaaaagaaatatacctaaa

SEQ ID NO: 1666 - DNA, 944 bp, Homo sapiens
  ENST00000380920
tgtcagtgatcagtttggtgaagggggaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagg

SEQ ID NO: 1667 - DNA, 887 bp, Homo sapiens
  ENST00000574330
tgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagtgagtgcgcgccctccctcggcctgggtccggccgccttcgcgccctggggccctgggctgaggagtctggagcgacccgcctgcggatccgacctcctggggcccacagctggctctgtccccaggaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattt

SEQ ID NO: 1668 - DNA, 1552 bp, Homo sapiens
  ENST00000574388
acacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaagtaaaatgggaagagaggtggcgggaggctggctgggggtgcaggggtgcggagggaacccagggtgtgttggggggtgctgggtgggaaacatcagaggatggattctggatgtcaggcctgggaggggatggaggaaagaagaaagctcccggtggggcgcggtggtccacgcctgtaatcccagcacgttgggaggctggggtgggtggattgcctgagctcaggagtttgagacaagcctgggcaacacggtgaaaccccgtctctactaaaatacaaaaaagtagccaggcgtggtggcgtgcacctgttgtcccagctactccagaggctgaggcaggagaaccgcttgaacccgggaggcagaggttgcagtaagctgagatcatgccactgcactccggcctggggacagagcaagactccctctcaaaaaaaaaaaaaaaaagaaaagaaaaaaaagaaaaagaaaagaaagaaagaagaaaggtctccatgatggagccgtcaatcagatgggagtaaagagatgggcccctcattcccactctagtcctggtgagcccccacctcagccccagcctcagtcttgactcagtcccaggtccagcgccagccctatcatgaccaaggagtatcaagaccttcagcatctggacaatgaggagagtgaccaccatcagctcagaaaagactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaa

SEQ ID NO: 1669 - DNA, 797 bp, Homo sapiens
  ENST00000572879
tctggccctgcagggtcgcccaccgcccgcatttcttcatgtacatggttcctcctagactactagggccgccttagcttgctacccttttaggaccctggagctgtgccagggtcccctctgtccccgcgctcctgacaccccctcctcttgcagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccaggatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagtgagtgcgcgccctccctcggcctgggtccggccgccttcgcgccctggggccctgggctgaggagtctggagcgacccgc

SEQ ID NO: 1670 - DNA, 627 bp, Homo sapiens
  ENST00000570576
ggagggggtggactgaggttcctggattggctgcagtgacgcagtcatgccattaggtgtcagcaaaagctcagggcctcggtgggatggggcggctcagcgcttagcccccttccccagccctcttttctccccgatttccagttgcctctggccctgcagggtcgcccaccgcccgcatttcttcatgtacatggttcctcctagactactagggccgccttagcttgctacccttttaggaccctggagctgtgccagggtcccctctgtccccgcgctcctgacaccccctcctcttgcagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgt

SEQ ID NO: 1671 - DNA, 2083 bp, Homo sapiens
  ENST00000573596
ttggacacacagacacgcagacacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaaggtgagggccaccttgccctgcctctgcaaggcgagaatttggcggttctccaccccccagccacagctcctactcttgcccgtgagcctggctctctctctgggtctgtctccctcccccaacactgggaaaggtgtcggaactgcctctctcaggagaggggcggagtgtggggttggagtccctttattggtgacaggtgcccaaagctttcctgtgcctcctggccctcggaggtggacccgggggtgtgggaacagctggaagctggagagatgaggtcactgtcggcttcctatgacgaagtcacgccccctcttcctttccccttccaacaccacccagggaccccggtcgtgcgagcgtgtgcgtgtgtgtgtcagtgatcagtttggtgaagggggaaaaggtttctgtgaagggtctgaggattctgtgaggggggcgatgaggggtctctgacctgagggagaacgagactcttttgcttcaaaaacaaattccccttgacccatttctttgtcctccgagcagggaattgtttaggctgagcaaggatgaagttcgtgggggatggggtgcagcgcgctttgacggaaggagggtccgcagcggaggagacccggcagggaggcccccccaaccctccagctctcagggcacagggctaacgtgtctcttccccctgctgggtggaagacttgagggcctgaatggtagctattgcaccttctctccctgcacgcagccaaagacaagtggaattcatggacagagaaagaaaccttccttctttccccactttcaggggaagcagcgactccgaggcgcgggccactcaattgcgtttcaaggcgcgggaggagggggtggactgaggttcctggattggctgcagtgacgcagtcatgccattaggtgtcagcaaaagctcagggcctcggtgggatggggcggctcagcgcttagcccccttccccagccctcttttctccccgatttccagttgcctctggccctgcagggtcgcccaccgcccgcatttcttcatgtacatggttcctcctagactactagggccgccttagcttgctacccttttaggaccctggagctgtgccagggtcccctctgtccccgcgctcctgacaccccctcctcttgcagggccacctcctccccagcccctcctgcagcgtctctgctccggacctcgcctcctcctgctctccctgggcctcagcctcctgctgcttgtggttgtctgtgtgatcggatcccaaagtgggtgccccaggggtgggaagggggcaacattggggggtgttgacgggggaccgtggcaagggagtggtgggtgcagtggtggcggacacagcgatcccgttttcttctctctgcacgctgtcctggccagactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaaggtcagagagggagtgtgtgtgtgtgtgtgtgtgtgtgaaagagagtgagaatgtgtggatgtgtgtgagaaagtgtgagtgtgtgtggatgtgtgtgagaatgagagggagtgtgtgtgtgtgtgagtctgtgtgtgagaatgagggggagtgtgttttgggtgtgtgtatgagagccttgtgtggatgtgagaatgagagggagtgtgtatgtct

SEQ ID NO: 1672 - DNA, 855 bp, Homo sapiens
  ENST00000573083
cacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaaccaggcgtggtggcgtgcacctgttgtcccagctactccagaggctgaggcaggagaaccgcttgaacccgggaggcagaggttgcagtaagctgagatcatgccactgcactccggcctggggacagagcaagactccctctcaaaaaaaaaaaaaaaaagaaaagaaaaaaaagaaaaagaaaagaaagaaagaagaaaggtctccatgatggagccgtcaatcagatgggagtaaagagatgggcccctcattcccactctagtcctggtgagcccccacctcagccccagcctcagtcttgactcagtcccaggtccagcgccagccctatcatgaccaaggagtatcaagaccttcagcatctggacaatgaggagagtgaccaccatcagctcagaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtga

SEQ ID NO: 1673 - DNA, 1384 bp, Homo sapiens
  ENST00000619926
cccaaacggtgcacggaagagtgaggtgactggcatgtgtgggggcaacacgattctcctccctggggagcagagcagaggcaacccatcccccactcccacccccacactcccctaagttccaatccatttccacctctgtttactgtccaaagtcccgggcactggagatgccacgtttggcgtgcttggacacacagacacgcagacacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaactttttttttttaagagtaaaaagaaatatacct

SEQ ID NO: 1674 - DNA, 4072 bp, Homo sapiens
  ENST00000228468
agacagcctcgcagacactcgtaggcgcgcacgcgcaccctctcccctccccctcccctcccgccgcctcccggccggacgatggatccctgcagatcccagggctgagagcaccgcgcaccgcgccgagcccgggcagaccgagccgaggcgagcgagccagcgagccagcgcgcgcgggcgggcggacagatcggagccgagcggggccgggcggggcgctccctgcagggctctgcgcggcgtgccgcggcggccgcgggctccggccccgggccatgagcccctccgcgactcggcgctgagcccgccaccggtccagcgccccaggacccgccgccggctgccggcttgccgaagccccctcaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctccctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgctttagccaagtctccaagaatgacctgtatcatgctggggagctgctggccctgctcaacaacaggtatgagataccagacacacagatggcagatgaaaagcagctggagatactgcaggacaaagccaacttccgcagcttcaaacccaaacccttcaacatgcgtgagttctacgaccgagctgggcacgacattcgagacatgctgctctcctgccacttccggggggaggtctgcagcgctgaagacttcaaggtggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgagctgctgatgacacctgtccccttctcatgccatgggcatggcgtggctccctatcatccaaaagcagggtgctcacttctgtcccatgagggtcctccaccccagaggcccttccccaaaccctgttgtcttggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagaccgggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaacca

SEQ ID NO: 1675 - DNA, 3778 bp, Homo sapiens
  ENST00000447966
gagccagcgagccagcgcgcgcgggcgggcggacagatcggagccgagcggggccgggcggggcgctccctgcagggctctgcgcggcgtgccgcggcggccgcgggctccggccccgggccatgagcccctccgcgactcggcgctgagcccgccaccggtccagcgccccaggacccgccgccggctgccggcttgccgaagccccctcaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctccctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgctttagccaagtctccaagaatgacctgtatcatgctggggagctgctggccctgctcaacaacaggtatgagataccagacacacagatggcagatgaaaagcagctggagatactgcaggacaaagccaacttccgcagcttcaaacccaaacccttcaacatgcgtgagttctacgaccgagctgggcacgacattcgagacatgctgctctcctgccacttccggggggaggtctgcagcgctgaagacttcaaggtggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagaccgggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaacca

SEQ ID NO: 1676 - DNA, 3819 bp, Homo sapiens
  ENST00000550558
agccgagcggggccgggcggggcgctccctgcagggctctgcgcggcgtgccgcggcggccgcgggctccggccccgggccatgagcccctccgcgactcggcgctgagcccgccaccggtccagcgccccaggacccgccgccggctgccggcttgccgaagccccctcaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctccctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgctttagccaagtctccaagaatgacctgtatcatgctggggagctgctggccctgctcaacaacaggtatgagataccagacacacagatggcagatgaaaagcagctggagatactgcaggacaaagccaacttccgcagcttcaaacccaaacccttcaacatgcgtgagttctacgaccgagctgggcacgacattcgagacatgctgctctcctgccacttccggggggaggtctgcagcgctgaagacttcaaggtgaagcccatgcaggtggcaaaggagctcaggcgatgcaccctaccaggaacagttttccagggcacacagagggcaagaaagggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagaccgggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaacca

SEQ ID NO: 1677 - DNA, 1481 bp, Homo sapiens
  ENST00000453327
acattcgagacatgctgctctcctgccacttccggggggaggtctgcagcgctgaagacttcaaggtgaagcccatgcaggtggcaaaggagctcaggcgatgcaccctaccaggaacagttttccagggcacacagagggcaagaaagggtgagaaacaggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctg

SEQ ID NO: 1678 - DNA, 1223 bp, Homo sapiens
  ENST00000551199
aagtctggaagtcctctctgaagcacttcctggggaatgcaaaggaggaggcccctgccctctgagagctcaagatctggcaggcaggaaaaagatacacacaggacaggacacacaggttcatgcaggagaagcctgaggacagcagctgaaggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacatagggcaggtatctccatcagcatctcattttatggatatggaaactgagattcagagaggctgccttgccaaggtcacctggttagtaagagatagagatatgacttgaacctaggtctcctcccccaatccctgtgcagggagaacatcctggtgctggacattttctttgaagtcctcaactatgagaccattgaacagaagaaggcctatgagattgcagggctcctgggtgagctgctgatgacacctgtccccttctcatgccatgggcatggcgtggctccctatcatccaaaagcagggtgctcacttctgtcccatgagggtcctccaccccagaggcccttccccaaaccctgttgtcttggtaagtggtgagggaagggaactgagccttctcttagggcaaagtggaaaagaga

SEQ ID NO: 1679 - DNA, 3327 bp, Homo sapiens
  ENST00000552438
cctggagaaaatgcccatccagatcttctgctccatgtcattctcctctggagaggaagccccagggcccttgggagatatttggggtccccaccaccatcagcagcagcaggacatctcagaatcggaagaggaggaagaagagaaggaaaaggaggcagtgaggaaggaggccagtgaggggcattcacccatggacttggtggcctttgccaacagctgcaccctccatggcaccaaccacatttttgtggaggggggtccagggccaaggcaggtgctgtgggcggtggcctttgtcctggcactgggtgccttcctgtgccaggtaggggaccgcgttgcttattacctcagctacccacacgtgacccttctaaacgaagtggccaccacggagctggccttcccggcagtcaccctctgcaacactaatgctgtgcggctgtcccagctcagctaccctgacttgctttatttggcccccatgctgggactggatgaaagtgatgaccccggggtgcccctcgctccaccgggccctgaggccttctctggggagccctttaacctgcaccgcttctacaatcgctcctgccaccggctggaggacatgctgctctattgctcctaccaagggggaccctgcggccctcacaacttctcagtggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagaccgggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatctta

SEQ ID NO: 1680 - DNA, 350 bp, Homo sapiens
  ENST00000549792
agtgagcagtactaggaaatcgttatcacttctaggctgaagaagcacaaaagaagacagtgctctgtagggagccctggcaggatctgtaatcatggagggcctaaggcactactagagctacagaggggcgagggctggggaaggattcataccccaatctttcctcctgccttctgagccattaccaatacctcccaactgtcaaccccaactagaagcccatgcaggtggcaaaggagctcaggcgatgcaccctaccaggaacagttttccagggcacacagagggcaagaaagggtcttcacacgctatggaaagtgctacacgttcaactcgggccgagatgg

SEQ ID NO: 1681 - DNA, 560 bp, Homo sapiens
  ENST00000548350
taccatggactcggatttggatttcttcgactcctacagcatcactgcctgccgcatcgactgtgagacgcgctacctggtggagaactgcaactgccgcatggtgcacatgccaggtcaggcctggggctccgagcatactcctggggtccctgggcctttgctgcccttcactagctccccatccatatcaatctcccaaccccagttccagcccaccccatcccacacccacctggctcatgtctctctgacctcagttcccgcctgcacccccagggatgggtgggaagggtctagaaggtatggacctggagtgggtcacttctggggcagcatgggggcctgccagtcctcccttcccatcttctcccagcttacaccttctaggcctttggtactaccaccatcaccagaccccttgaattcccatcctgcatcattgtcttttctcctctgtaggggatgccccatactgtactccagagcagtacaaggagtgtgcagatcctgctctggacttcctggtggagaaggaccaggagtactgcgtgtgtgaa

SEQ ID NO: 1682 - DNA, 614 bp, Homo sapiens
  ENST00000552633
ggagaacatcctggtgctggacattttctttgaagtcctcaactatgagaccattgaacagaagaaggcctatgagattgcagggctcctgggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtgagttggactctctcccctggtgtctgtactgtgtacacacatccctctgagaagcacaaggagacgacacgcgcattgtaacctttgcactgtctcagtggcg

SEQ ID NO: 1683 - DNA, 3443 bp, Homo sapiens
  ENST00000225823
cacctgggagagccgaggcgagaagcgacacttccctgcggctagcatccttgaaggaccccggcggcgaacagcctcccgcaggacgccctgagaagctctcagccccaggcgagagcgggcgcctggcaggacttaggcgcaggacttggggaagcctaagcaggtctctgccgagcgcagcccagggagcagtaacaaggaagggtcctggaggggaagggaaagaaggcggcagccggcaaggcgaccactcacccccgtacacacccaccccgcccgcccagccaggagccgcggtgcgcctctgggggcgctcgttccttggcgccttctctcccgtgtcccagcaccgctgggctacgggccgggctggtggggtccctggggatgtccagatcaggcatggtggccgagtggcccttctcccaggaccagcgtaaaagctggggttaggcggggcaggggggactcggctcagggtcccccgaggtccaggacgagggaaggcgggcgcagcacccagggactggagaggcggctcccagtgggacccctccagaagtagtgccgggcgccgggcatcctccaggaagaccaggggccgggaaagcctgggaggcgctcgggagaggccactgccaggggctgcgggctgaggcggcgctcagccccgggcgggcgcccgcggaggcggcagcggcggcgccgggcgggcatgccgcgccaccggagctcctttcgggcgcacgcttccctggcgcgggctgcgcgcggctgccgctgctgctgcttccactgctgctgcggactcccatggcggctccgcccggccggggccgccgccgctgccgccagccgcgggctgaatgaatgagccggattggcggagccgggctgcccgcagccgcgctcaccggcccgggacgcttccgcatggcccgcgaggagccggcgcccgcggcgttggcggctgccgggcagcccgggggcggcagaggcggcgagcgggcgctgcaggggccaggggtcgcccgcagggggcggccatcgctgagccgcgctaaactgcacgggctgcggcacatgtgtgccgggcgcacggcggctgggggctccttccagcggcgggcgctgtgggtgctggccttctgtacatccttcggcttgctgctgtcctggtcctcgaaccgcttgctctactggctcagcttcccgtcacacacgcgggtgcaccgcgagtggagccgccagttacccttccccgccgtcactgtgtgcaacaacaacccgctgcgcttcccgcgcctctccaagggggacctctactatgccggccactggctcgggctgctgctgcccaaccgcaccgcgcgcccgcttgtcagcgagctgctgcggggcgacgagccgcgccgccagtggttccgcaagctggcggacttccgcctcttcctgcctccgcgccacttcgagggaatcagcgccgccttcatggaccgcctgggccaccagctggaggacatgctgctctcctgcaagtaccgcggcgagctctgcgggccgcacaacttctcctccgtgtttacaaaatatgggaagtgttacatgtttaactcaggcgaggatggcaaacctctgctcaccacggtcaagggggggacaggcaacgggctggagatcatgctggacattcagcaggatgagtacctgcccatctggggagagacagaggaaacgacatttgaagcaggagtgaaagttcagatccacagtcagtctgagccacctttcatccaagagctgggctttggggtggctccagggttccagacctttgtggccacacaggagcagaggctcacatacctgcccccaccgtggggtgagtgccgatcctcagagatgggcctcgacttttttcctgtttacagcatcaccgcctgtaggattgactgtgagacccgctacattgtggaaaactgcaactgccgcatggttcacatgccaggggatgcccctttttgtacccctgagcagcacaaggagtgtgcagagcctgccctaggtctgttggcggaaaaggacagcaattactgtctctgcaggacaccctgcaacctaacccgctacaacaaagagctctccatggtgaagatccccagcaagacatcagccaagtaccttgagaagaaatttaacaaatcagaaaaatatatctcagagaacatccttgttctggatatattttttgaagctctcaattatgagacaattgaacagaagaaggcgtatgaagttgctgccttacttggtgatattggtggtcagatgggattgttcattggtgctagtatccttacaatactagagctctttgattatatttatgagctgatcaaagagaagctattagacctgcttggcaaagaggaggacgaagggagccacgatgagaatgtgagtacttgtgacacaatgccaaaccactctgaaaccatcagtcacactgtgaacgtgcccctgcagacgaccctggggaccttggaggagattgcctgctgacacccctcgagtcacccagcactccctccaaacagaccttgaggcccaagacccaggacaaggaacagcaagctcaggtgggatggccccagtgctggaaagaagcaagagccccctatgcacacattgcagactagctgcctagacctcgctccggccacgtccaacacgacgcatccttgggccccgccgtgcgtccctcttaggagagatgagtcacactctggaactgtccaagaacgaacctgccatcacatctcactgccagatgtataaagcacctgcatgctcagacttcttgtggcgccacctccacgtctgtcttgtacatgacactcctccacgcggtttccagtgtccacactgctgcccgtgcagtgggaccagattccaggtccaaagtcaccatgaggccaccctggaatcagaactgcacaatcaagagggaacccatgggactctctgctacattcagttcttgtgtcgtttgtgaaagttcttaacctgcccaaaaacccccttttccccaagctgcccatggggcttcggcgccaaaggtgacccgcgccaacctccctcccccccagtgcctatgacggcggcacagcagccagcgggtgggggacgcctgtgttcacccatggtgcccatgtcgttcttctctccctgtgacacagcttgtacagtctgattctttttatctggggtaggggggcttttatgtttgtccgatggagatttgttttgttttgcttcattttatgcttttttattttagttttgatgttctgaggtttgctttggtttttccattttctttggcatttatttattcgtgcttcaaatcacagtcatattaaaagctggtcttgtggaaa

SEQ ID NO: 1684 - DNA, 3179 bp, Homo sapiens
  ENST00000359872
ttttttcccaggaggcgaggagagaatggatcccggtctgagctccccgcttccgtccccagtctccagataccggtcctcgcctctccgcgccgcgcgctgcctcctctccccggtgctagcagcggccgctggcatttggaattctgcccacaaaagggggcctggaggaggaggagaggagggacggaggccggcggcgagaaacggcattcggagtccaaaacatcatgggaaaaggaaccgagcggcggcggctctgaaggctgtgccgctgcgcccgaccgcagtgcatcagcgtggccgccctgacatcccccaggatggttaacatggggcattatgcgctggttaacaggctccgagctgctcagcgacttgttttaagcattttctctctcgctctcgcttttaatcttgtctctagtggcgtgtgtaggggggaggactttatttccattggctaagctctcccttcccacccacatctcttccacatcaccttggtgtctccctaaataaaaccagccctccttatcgcctggaaaaaatcaagagctagagtttgaatgggttttatataaacactcacccctgtcagcgtgcggctgggctctcaggataaactcacagcatctggcgcgatgcttgccttgcgttctctcccctgaacgtcaaggtttaagcagagcccgaggactgggagctcttctctgaaattcgatcaacctgaagccagttgcggaactgcacggggtcccgatggacctcaaggaaagccccagtgagggcagcctgcaaccttctagcatccagatctttgccaacacctccaccctccatggcatccgccacatcttcgtgtatgggccgctgaccatccggcgtgtgctgtgggcagtggccttcgtgggctctctgggcctgctgctggtggagagctctgagagggtgtcctactacttctcctaccagcatgtcactaaggtggacgaagtggtggctcaaagcctggtcttcccagctgtgaccctctgtaacctgaatggcttccggttctccaggctcaccaccaatgacctgtaccatgctggggagctgctggccctgctggatgtcaacctgcagatcccggacccccatctggctgacccctccgtgctggaggccctgcggcagaaggccaacttcaagcactacaaacccaagcagttcagcatgctggagttcctgcaccgtgtgggccatgacctgaaggatatgatgctctactgcaagttcaaagggcaggagtgcggccaccaagacttcaccacagtgtttacaaaatatgggaagtgttacatgtttaactcaggcgaggatggcaaacctctgctcaccacggtcaagggggggacaggcaacgggctggagatcatgctggacattcagcaggatgagtacctgcccatctggggagagacagaggaaacgacatttgaagcaggagtgaaagttcagatccacagtcagtctgagccacctttcatccaagagctgggctttggggtggctccagggttccagacctttgtggccacacaggagcagaggctcacatacctgcccccaccgtggggtgagtgccgatcctcagagatgggcctcgacttttttcctgtttacagcatcaccgcctgtaggattgactgtgagacccgctacattgtggaaaactgcaactgccgcatggttcacatgccaggggatgcccctttttgtacccctgagcagcacaaggagtgtgcagagcctgccctaggtctgttggcggaaaaggacagcaattactgtctctgcaggacaccctgcaacctaacccgctacaacaaagagctctccatggtgaagatccccagcaagacatcagccaagtaccttgagaagaaatttaacaaatcagaaaaatatatctcagagaacatccttgttctggatatattttttgaagctctcaattatgagacaattgaacagaagaaggcgtatgaagttgctgccttacttggtgatattggtggtcagatgggattgttcattggtgctagtatccttacaatactagagctctttgattatatttatgagctgatcaaagagaagctattagacctgcttggcaaagaggaggacgaagggagccacgatgagaatgtgagtacttgtgacacaatgccaaaccactctgaaaccatcagtcacactgtgaacgtgcccctgcagacgaccctggggaccttggaggagattgcctgctgacacccctcgagtcacccagcactccctccaaacagaccttgaggcccaagacccaggacaaggaacagcaagctcaggtgggatggccccagtgctggaaagaagcaagagccccctatgcacacattgcagactagctgcctagacctcgctccggccacgtccaacacgacgcatccttgggccccgccgtgcgtccctcttaggagagatgagtcacactctggaactgtccaagaacgaacctgccatcacatctcactgccagatgtataaagcacctgcatgctcagacttcttgtggcgccacctccacgtctgtcttgtacatgacactcctccacgcggtttccagtgtccacactgctgcccgtgcagtgggaccagattccaggtccaaagtcaccatgaggccaccctggaatcagaactgcacaatcaagagggaacccatgggactctctgctacattcagttcttgtgtcgtttgtgaaagttcttaacctgcccaaaaacccccttttccccaagctgcccatggggcttcggcgccaaaggtgacccgcgccaacctccctcccccccagtgcctatgacggcggcacagcagccagcgggtgggggacgcctgtgttcacccatggtgcccatgtcgttcttctctccctgtgacacagcttgtacagtctgattctttttatctggggtaggggggcttttatgtttgtccgatggagatttgttttgttttgcttcattttatgcttttttattttagttttgatgttctgaggtttgctttggtttttccattttctttggcatttatttattcgtgcttcaaatcacagtcatattaaaagctggtcttgtggaaa

SEQ ID NO: 1685 - DNA, 750 bp, Homo sapiens
  ENST00000448983
cggcgagctctgcgggccgcacaacttctcctccgagtcttgagcatccagcggaactgagcagtggtgcgccagggttgggcccttcacctggcctccgtcccccataaaatgtgtttacaaaatatgggaagtgttacatgtttaactcaggcgaggatggcaaacctctgctcaccacggtcaagggggggacaggcaacgggctggagatcatgctggacattcagcaggatgagtacctgcccatctggggagagacagaggaaacgacatttgaagcaggagtgaaagttcagatccacagtcagtctgagccacctttcatccaagagctgggctttggggtggctccagggttccagacctttgtggccacacaggagcagaggctcacatacctgcccccaccgtggggtgagtgccgatcctcagagatgggcctcgacttttttcctgtttacagcatcaccgcctgtaggattgactgtgagacccgctacattgtggaaaactgcaactgccgcatggttcacatgccaggggatgcccctttttgtacccctgagcagcacaaggagtgtgcagagcctgccctaggtctgttggcggaaaaggacagcaattactgtctctgcaggacaccctgcaacctaacccgctacaacaaagagctctccatggtgaagatccccagcaagacatcagccaagtaccttgagaagaaatttaacaaatcagaaaaatata

SEQ ID NO: 1686 - DNA, 559 bp, Homo sapiens
  ENST00000579816
agtcagcctccttcttcccgacctcaactccaggccctcaggactccaagaaactgctctgtgtttggagtgtagatctcttaagtgcggacttcttgtctttgggaaaaccaatagacggctcttaaaaaaaaaaaaaaaaaaaaggaagcgcttgaaaaatggatcatcaggggaatcacgcagagtccctaagcaggcctacgatccgaagcagcttatgtcttcaaagttcccaaacacttagaatctaggagaacttgtgaggaaactcccagaaaaccaacactgaagctgtagacagtttggtgggagaggcagcagcatgctttggctactttttcaaaatgcaggagtcttgagcatccagcggaactgagcagtggtgcgccagggttgggcccttcacctggcctccgtcccccataaaatgtgtttacaaaatatgggaagtgttacatgtttaactcaggcgaggatggcaaacctctgctcaccacggtcaagggggggacaggcaacgggctggagatcatgctggacattcagcaggatgagt

SEQ ID NO: 1687 - DNA, 508 bp, Homo sapiens
  ENST00000583395
cattcatgccctactcctagcatgtgtttggtgcacagcgagcactatagtaactattgatgttgttaacacattatttccttcctattatccttaagagggagttcttaccttctcatcccatctctttagttttcttaatataactctaaattaaaataaaactcttcactttgttaggaagaggaccatgacttgcttaggcccgactaacatttgcactcaccattttgttacacagatggcaaaccaggaaaacagagctcagtacagaagggagttgggcagcctctgttcctgtttggctctgtccttgaagaaagtgataagaagtgcacagattttggaattaaacagaccatggtttgaagtctggatcttccagttgtaaccaggtggcattgggaggcgaggagagaatggatcccggtctgagctccccgcttccgtccccagtctccagataccggtcctcgcctctccgcgccgcgcgctgcctcctctcccc

SEQ ID NO: 1688 - DNA, 3340 bp, Homo sapiens
  ENST00000461395
acccagtgagcggctagggtgcagcaggagtttgggggatagccccagtcttgggatctctgtcctgggctggggactgccccctcccctggcctggctcctgacgcccgtgctgccggtgaaacgctgttgacatgtcctgaattattaagcgtggggagggctccggagcacatgctgagcggagcggctggggctgcgcggcgtggcggagcagcgctcgctccctcgctcactcgctcgctcgcagggacacacgcaggggctgacagctgtgctggtgctgataagggaagccacaaggagacgatcgaggagagagacaagcggcagcagaggcagcagcggcagaggcagcaccagggctgcggagctgctgggagtgggagtgactcccccacctcgggcccccaccctgtccctgtcctcttcccgcttgccctgagtttagaagagcagccgctgccaccactgccactcgggagggcaccagggctgctggctagggagggacagggcagggaggctctggccagtcccagcagccggggacagatgccgatcgagattgtgtgcaaaatcaaatttgctgaggaggatgcgaaacccaaggagaaggaggcaggggatgagcagagcctcctcggggctgttgcccctggagcagccccccgagacctggccacctttgccagcaccagcaccctgcatggactgggccgggcctgtggcccaggcccccacggactgcgcagaaccctgtgggcactggccctactcacctcgctggctgccttcctgtaccaggcggctggcctggcccggggctacctgacccggcctcacctggtggcaatggaccccgctgccccagccccagtggcgggcttcccggctgtcaccctctgcaatatcaaccgcttccggcattcggcactcagcgatgccgacatcttccacctggccaatctgacagggctgccccccaaagaccgggatgggcaccgtgcggctggcctgcgctacccagagcctgacatggtagacatcctcaaccgcactggccaccagctcgccgacatgcttaagagctgcaacttcagtgggcatcactgctccgccagcaacttctctgtggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcgggtgagcatctcctgctaggccctggattgggcacagggctcgcctttgggctcagaggggatgtggagcaaacctgccctctagaagctcagagcctgccagctgtgttgactttgctggggctgtgggcactggaggactgggtgggattcctgagcatgacctcatcatgccccacctctgcagctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggtgggcaccccacccccagccagccctccatgccaccctgctaggctccagagcctcccggggcaaggcactgctcatgtgcacaggcaggtgcatgtatacaacatgtgtatgtgtctgtacccgtgtgagtgtgagtgtttgggatttttaaacatggtttcacatatgcatgtgggaatgccggcatgcagatgcctgtgtgcatgttaatatgtatttgtgtacgtgcatgctcatttatatccgtggttgcgtatttgtgggggttgtgtgtgtggtgttcaagcacatttatgcaaatgtgtgcatatgtgtgtgcatgcatgtatgtgcttacatttgggcgtgtgggggacaggggaagtgatcgtagattccaggaataatcttctctcctttcaggcaatgagaccatctgcccaccaaatatctacatcgagtgtgcagaccacacactgggtccgtgctgcctaccctttcctacctctccatcagcctcttcatgtctctgtccactcttctcctcactgtcttggatcctcccctcccaatctcttcctggagggttcttcctgggggttgagccttagcccatacttcagtggggttggggagaggtctgcggacctctgcaggtacagacacttgggtaagtggaggcagcagggtggggggttgcagagaagccaggactgggagtgaaggtctgggcttctcatcttggttcagccaatgagctcacccactttgagaaagtgaaatgacttctctcttggtctcaggaaaaatgcattgctggctatcggtgtgggtaaggcaaaccccatctgtccacagatcttgcctgatctgcagttcatccatctatccatccattcatcgattcgcgcattctccagacctttacagcctgtgctgggtactggaggtgagagtgggggcgacagccctgcccttggagagcttacaccccggcagggctgtggacagccattcccacacagcccgtcaactcctggagaggggagcctcgggtgtgctgcaaggccccaaggaggggtgtgcagccctagcctgggaaggtagggaggattcctagaggaagggacacattagctgaggcttgatgggtgtataagagtcaggtgcaaagggggacatacactgaagacctgtggccagaaagagcatgctgtgtccggggcactgaaaggtctgtgtggctgcagggcagagaacaggggagggagtagaaagagtagaggagggaggccaggcacggtggctcacaagtgtagacccagcactttgggaggccagggtctgtggatcacttgagcccagtagttcaagaccagcctgggcaacatggtgagaccctgtctctgcaaaaaataaaaaagtgaactgggtgtggtggtgcacatctatagtcccacctattcgggaggctgaggcaagaggataggcttgagcctgggaggttgaggctgcggtgagctgggatcacaccattgcactctagtctgagctacagagttaccctgtctcaaaaaaaaaaaaaaaaaaaaaaaaaaa

SEQ ID NO: 1689 - DNA, 2684 bp, Homo sapiens
  ENST00000347842
gggctccggagcacatgctgagcggagcggctggggctgcgcggcgtggcggagcagcgctcgctccctcgctcactcgctcgctcgcagggacacacgcaggggctgacagctgtgctggtgctgataagggaagccacaaggagacgatcgaggagagagacaagcggcagcagaggcagcagcggcagaggcagcaccagggctgcggagctgctgggagtgggagtgactcccccacctcgggcccccaccctgtccctgtcctcttcccgcttgccctgagtttagaagagcagccgctgccaccactgccactcgggagggcaccagggctgctggctagggagggacagggcagggaggctctggccagtcccagcagccggggacagatgccgatcgagattgtgtgcaaaatcaaatttgctgaggaggatgcgaaacccaaggagaaggaggcaggggatgagcagagcctcctcggggctgttgcccctggagcagccccccgagacctggccacctttgccagcaccagcaccctgcatggactgggccgggcctgtggcccaggcccccacggactgcgcagaaccctgtgggcactggccctactcacctcgctggctgccttcctgtaccaggcggctggcctggcccggggctacctgacccggcctcacctggtggcaatggaccccgctgccccagccccagtggcgggcttcccggctgtcaccctctgcaatatcaaccgcttccggcattcggcactcagcgatgccgacatcttccacctggccaatctgacagggctgccccccaaagaccgggatgggcaccgtgcggctggcctgcgctacccagagcctgacatggtagacatcctcaaccgcactggccaccagctcgccgacatgcttaagagctgcaacttcagtgggcatcactgctccgccagcaacttctctgtggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccagactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagccggggccgagtggagggtgggggggtcagcagtctgctccccaatcaccaccacccccacggtcccccaggaggtctctttgaagattttgcttgctaggacggtgctgtgactgaaaggacccaggagtctgggacccctcctgggatccccagcacattctcctgctcctgggagaggcctgggggcggtgctcactgggagggccaggactcagttcctgctctcatcctcccctgccctgatgtcagctgctttgcacaaaggtccttcttgtccacaccccttatccccaggctggtgccccgggagggctggagaccaggccatgggccctcacggagaggaagggaaggaaggagagggagggggaggatagagcccatcccagccggggagggggagccctctgtacatttgtaaatatttagggaaagccgggtggggggaggggatacagatgtagaaggtgggtagggctacaggggtgggtgatttagggacagccagggtcccagccccaatgtcagcaggatagggagagccccaggactcaggagtgctgggctggtcctacttcctgcccctctccaggcccagctcccctcttggcagggggagaggatggcccagcaggcctggcccagctcccagttccccctgcaccagccccacccctagagtcccttctatagggagggggcaggagaccttccagacttcggctgagcttggagggtgggaagggagccttctcagtcctctctccctccagtctgattttataaagtgctgacgagattgggaataaagaggcataaagaa

SEQ ID NO: 1690 - DNA, 2741 bp, Homo sapiens
  ENST00000358078
gggctccggagcacatgctgagcggagcggctggggctgcgcggcgtggcggagcagcgctcgctccctcgctcactcgctcgctcgcagggacacacgcaggggctgacagctgtgctggtgctgataagggaagccacaaggagacgatcgaggagagagacaagcggcagcagaggcagcagcggcagaggcagcaccagggctgcggagctgctgggagtgggagtgactcccccacctcgggcccccaccctgtccctgtcctcttcccgcttgccctgagtttagaagagcagccgctgccaccactgccactcgggagggcaccagggctgctggctagggagggacagggcagggaggctctggccagtcccagcagccggggacagatgccgatcgagattgtgtgcaaaatcaaatttgctgaggaggatgcgaaacccaaggagaaggaggcaggggatgagcagagcctcctcggggctgttgcccctggagcagccccccgagacctggccacctttgccagcaccagcaccctgcatggactgggccgggcctgtggcccaggcccccacggactgcgcagaaccctgtgggcactggccctactcacctcgctggctgccttcctgtaccaggcggctggcctggcccggggctacctgacccggcctcacctggtggcaatggaccccgctgccccagccccagtggcgggcttcccggctgtcaccctctgcaatatcaaccgcttccggcattcggcactcagcgatgccgacatcttccacctggccaatctgacagggctgccccccaaagaccgggatgggcaccgtgcggctggcctgcgctacccagagcctgacatggtagacatcctcaaccgcactggccaccagctcgccgacatgcttaagagctgcaacttcagtgggcatcactgctccgccagcaacttctctgtggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactggactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagccggggccgagtggagggtgggggggtcagcagtctgctccccaatcaccaccacccccacggtcccccaggaggtctctttgaagattttgcttgctaggacggtgctgtgactgaaaggacccaggagtctgggacccctcctgggatccccagcacattctcctgctcctgggagaggcctgggggcggtgctcactgggagggccaggactcagttcctgctctcatcctcccctgccctgatgtcagctgctttgcacaaaggtccttcttgtccacaccccttatccccaggctggtgccccgggagggctggagaccaggccatgggccctcacggagaggaagggaaggaaggagagggagggggaggatagagcccatcccagccggggagggggagccctctgtacatttgtaaatatttagggaaagccgggtggggggaggggatacagatgtagaaggtgggtagggctacaggggtgggtgatttagggacagccagggtcccagccccaatgtcagcaggatagggagagccccaggactcaggagtgctgggctggtcctacttcctgcccctctccaggcccagctcccctcttggcagggggagaggatggcccagcaggcctggcccagctcccagttccccctgcaccagccccacccctagagtcccttctatagggagggggcaggagaccttccagacttcggctgagcttggagggtgggaagggagccttctcagtcctctctccctccagtctgattttataaagtgctgacgagattgggaataaagaggcataaagaa

SEQ ID NO: 1691 - DNA, 2403 bp, Homo sapiens
  ENST00000474489
gtgagaggaaaggagaggaagagctggagggggtgaggaagtaaggggagggaggcagagggttctgcttggtctccaggctaggaggcggtgcctggaggatacaggaacggggatcctctgatcaaggctggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactggactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggcaagggccctggagaaggcagggtgggagtgggggccgtgggcaaagcagaagggggcagtgcggggtgcctggtggagctggcctggctggaaagtcaggttcagggttctctgccagggtcccctgactggctggcaggcctgagggctcagagtcaggagaaggggatgggtgaggaggaggagggtgtcctactgggagtttgctgtggcagtaagtcctgtgggcagctgggcatggtaaggctcacgcttctcctcaaccaaatttcctgagcccactgctgtccccgaccctgaaccccaaggtgtcctgggatcgactgaagcgggtatggaggcgtcccaagacccccctgcggacctccactgggggcatctccactttggggcttcaggagctgaaggaacaggtgaggacaagctctaaatgcctgcagcatgcagccacacctccccaggactgaatacatccattgtttctgaaccagcctgtggagggggccctggagcctctgcccgaggtgacaaggaaaggctggcggtgtgagccctgggggcaccacttgagctctcccggtcccactctctcttttctttctcctgcagagtccctgcccgagccggggccgagtggagggtgggggggtcagcagtctgctccccaatcaccaccacccccacggtcccccaggaggtctctttgaagattttgcttgctaggacggtgctgtgactgaaaggacccaggagtctgggacccctcctgggatccccagcacattctcctgctcctgggagaggcctgggggcggtgctcactgggagggccaggactcagttcctgctctcatcctcccctgccctgatgtcagctgctttgcacaaaggtccttcttgtccacaccccttatccccaggctggtgccccgggagggctggagaccaggccatgggccctcacggagaggaagggaaggaaggagagggagggggaggatagagcccatcccagccggggagggggagccctctgtacatttgtaaatatttagggaaagccgggtggggggaggggatacagatgtagaaggtgggtagggctacaggggtgggtgatttagggacagccagggtcccagccccaatgtcagcaggatagggagagccccaggactcaggagtgctgggctggtcctacttcctgcccctctccaggcccagctcccctcttggcagggggagaggatggcccagcaggcctggcccagctcccagttccccctgcaccagccccacccctagagtcccttctatagggagggggcaggagaccttccagacttcggctgagcttggagggtgggaagggagccttctcagtcctctctccctccagtctgattttataaagtgctgacgagattgggaataaagaggcataaagaa

SEQ ID NO: 1692 - DNA, 613 bp, Homo sapiens
  ENST00000473709
aggaacggggatcctctgatcaaggctggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactgggtccgtgctgcctaccctttcctacctctccatcagcctcttcatgtctctgtccactcttctcctcactgtcttggatcctcccctcccaa

SEQ ID NO: 1693 - DNA, 2289 bp, Homo sapiens
  ENST00000394309
tttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaa

SEQ ID NO: 1694 - DNA, 1947 bp, Homo sapiens
  ENST00000454046
attttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggattggagagggagaaagaaaaactgctttgtgtgccaaaagcaaaactcttggtgtttttgtttgtgaaataggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatct

SEQ ID NO: 1695 - DNA, 1638 bp, Homo sapiens
  ENST00000437628
gaagcatcgagagggaaccgcggccggcaggccggaccgctccggagaggaggcagcggcagtttgagcccctatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatct

SEQ ID NO: 1696 - DNA, 1994 bp, Homo sapiens
  ENST00000394308
aaacttcccgcacgcgttacaggagccaggtcggtataagcgccagcggcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatct

SEQ ID NO: 1697 - DNA, 1865 bp, Homo sapiens
  ENST00000422745
ttcccgcacgcgttacaggagccaggtcggtataagcgccagcggcctcgccgcccgtcaagctgtccacatccctggcctcagcccgccacatcaccctgacctgcttacgcccagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaat

SEQ ID NO: 1698 - DNA, 1588 bp, Homo sapiens
  ENST00000455086
cctggcctcagcccgccacatcaccctgacctgcttacgcccagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaa

SEQ ID NO: 1699 - DNA, 1812 bp, Homo sapiens
  ENST00000444334
ataagcgccagcggcctcgccgcccgtcaagctgtccacatccctggcctcagcccgccacatcaccctgacctgcttacgcccagattttcttcaatcacatctgaataaatcacttgaagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggact

SEQ ID NO: 1700 - DNA, 689 bp, Homo sapiens
  ENST00000487714
tattctaatattagcagtttggtaggaaggaaggcatgttttgtgaagcattgcttacctctgttcagttatttactcccttccctaaatttgtttaactttttgtcttatccacctttaggattggagagggagaaagaaaaactgctttgtgtgccaaaagcaaaactcttggtgtttttgtttgtgaaataggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgc

SEQ ID NO: 1701 - DNA, 698 bp, Homo sapiens
  ENST00000462436
gccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggtaaccactctgaagtggagggatattcatgctatattaagaaaagtatgaattgtttgactattttctatcatctttcagtatgacagtgatatttttgagtatcttgtgaggttacaaaagggaatctgatagtgtttgctttctatctcttggggaagaaagaaattttaatgtgtcagataatttttattctttaaaactagttacagctgggtatgagggctcatgctcatacccccagctgctgaggaggctgaggtgggaggatcacctgaacccaggagattgaggctgcagtgagctgtgattgcaccactgcactcctgcctggttgacagagtaagaccccgtctcttaaa

SEQ ID NO: 1702 - DNA, 828 bp, Homo sapiens
  ENST00000442734
gattgttacgcacctgacagctagcggaaggacctttctgtcctggttccctgaagcatcgagagggaaccgcggccggcaggccggaccgctccggagaggaggcagcggcagtttgagcccctattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccct

SEQ ID NO: 1703 - DNA, 1678 bp, Homo sapiens
  ENST00000495255
catagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtaataataaatttttctatagattttcattattgtcttggttgtacgttttcttttaaattatatttgaaaatctcttagagagcaatccagaattttacaagtgactaagttatgagtctttacctttttttaaaaaaacagaggagttgtactctccttttcagcacttaaattctgtaatccttgaaggatgattctttagtgcagtcgtttattttttgctgtgctaatatgctctacatctagcttgatcttaagtgcagttttaagttttcctgtgtcatactataatcgtagggttgactctgcaattattgcattgtggtactttgcgcagttatagcacagcaagtgttaggatttctaaaacagctttattgataattcacataccatgtaattcacccacttgaagtatacagttcagtggtttttagtatattcacagatgttggtaaacaacactccaatcagttttaggattgtttttccacctcaaaaaaaaccaaatcaaatcctatgccctttaccttagtttttgctggcaggatcaactaggtttttgtttgtttgtttgtttgaagagatggggtcttgctcagtcgcccagcccaggctggagtgcggtggtttgatagctcagtgcagccttgaactcgtgggctcaagcgattctcccacctcagcctccctagtagctaggagtataggcatgcaccacaacaccctgcctcctgtgccctttagctttgaattccatctctccatatccatcagctgcacccctgcagttgtagccccggcaatcaccagtctttctgcctctggattccctattctgtatgtttcatatgaacgggattatatatcataccggcttttgtgactggattctttcacttggtatagtgctttcaagatttgtctatgccgtagcatgtatcagtacttacttcttatggccaaatgatattccattacatggatacactgcattttgtttattcgcttgtcagttgatggacatttaggacattatttaccccttttggctattatgaataatgctgctataaacattggtgtacaagtttttgtgtggacatttcccttgggtgtatatctaggagtagaattgctgggacacatgataactatgt

SEQ ID NO: 1704 - DNA, 745 bp, Homo sapiens
  ENST00000437657
ccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagaggtctgtttagggacacaggcgaccaagtacagaaaaagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaag

SEQ ID NO: 1705 - DNA, 579 bp, Homo sapiens
  ENST00000448127
tactgaacaatgcaactttgagacagaaatatttgagaacatttttgtcagtgaggacattttgatagtgaatattttgtatcttctattaacttgaaatgttttatttgttataaagccaggatatctgatatcaaattaaattgttttttttttccctttagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatgg

SEQ ID NO: 1706 - DNA, 573 bp, Homo sapiens
  ENST00000453600
aagctgtccacatccctggcctcagcccgccacatcaccctgacctgcttacgcccagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaaggtg

SEQ ID NO: 1707 - DNA, 562 bp, Homo sapiens
  ENST00000451771
atgatgaaacttcccgcacgcgttacaggagccaggtcggtataagcgccagcggcctcgccgcccgtcaagctgtccacatccctggcctcagcccgccacatcaccctgacctgcttacgcccagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccg

SEQ ID NO: 1708 - DNA, 584 bp, Homo sapiens
  ENST00000414884
acgcacctgacagctagcggaaggacctttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtc

SEQ ID NO: 1709 - DNA, 2356 bp, Homo sapiens
  ENST00000175506
agtcctgctccgccccggacaccccgcggccccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaccattgctgt

SEQ ID NO: 1710 - DNA, 563 bp, Homo sapiens
  ENST00000577034
aggggaagccgcgtggtgtgcgaccctgggcgttgagctccaggcttcctggcaaagaggactgtggattcctggccctgtgaccttgggcaaaaaatgaggaagattcataagtaagttaacacagaattaccaaaaacctcatgagaaagaaatgaagggatgtttcagggtagcttttcgagtcccaagtgatcattgatttggcccttctgtttctgattgtgaaaaagcattctgaaagaatgggcgccggttcaagaggaggtctctgagggtcagcctttggctgtttatagagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttgg

SEQ ID NO: 1711 - DNA, 1090 bp, Homo sapiens
  ENST00000456349
tttcggaagttaacttggtataagagtatgaaaagcctctgttgctctacttctgaggaaatgctctcctttttcctaataaagctttccacagaagacaaactctgtacacaaaaaacaagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttggcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaagacttctctggctccactaccctgctacgtttatctgattgagcatccttccctcaaatatgcgaccactcgttccatagccaagtatcctgtgggtatagaagttggtcctcagcctcaaggggttctgagagctgatatcttggatcaaatgagaaaaatgattaaacatgctcttgattttatacatcatttcaatgaaggaaaagaatttcctccctgcgccattgaggtctataaaattatagagaaagttgattacccccgggatgaaaatggagaaattgctgctatcatccatcctaatctgcaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattag

SEQ ID NO: 1712 - DNA, 5431 bp, Homo sapiens
  ENST00000263080
ttgtaacagaaaattaaaatatactccactcaagggaattctgtactttgccctttgggtaaagtctcatttacatttctaaacctttcttaagaaaatcgaatttcctttgatctctcttctgaattgcagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttggcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaagacttctctggctccactaccctgctacgtttatctgattgagcatccttccctcaaatatgcgaccactcgttccatagccaagtatcctgtgggtatagaagttggtcctcagcctcaaggggttctgagagctgatatcttggatcaaatgagaaaaatgattaaacatgctcttgattttatacatcatttcaatgaaggaaaagaatttcctccctgcgccattgaggtctataaaattatagagaaagttgattacccccgggatgaaaatggagaaattgctgctatcatccatcctaatctgcaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattagaaatcacttccagcttacatcttacacggtgtcttacaaattctgctagtctgtaagctccttaagagtagggttgtgccttattcaactgcatacatagctcctagcacagtgccttattcggtaggcatctaagcacatttcttaaattaattaatatatctttaaagatatcatattttatgtatgtagcttattcaaagaagtgtttcctatttctatatagtttattatacatgatacttgggtagctcaacattcttaataaacagcctttgtattcagaatataaaattgaaatagatatatataaagttatttgttttattgtgctttgccttactacacttcacggatactgtacttgtactttttttccaaattgaaggtttttggcaaccctgtgtctagaaagtctaacagtgccatgtttccaacagcatgtgctcactccttgtctctgtgtcaccctttgataatatttcaagcttttttatgatttatttattatatctgctatggtgatctgtgatcagtggcctttgatgttactgttgttaagtgttttggggcaccatgaatcgtgcccatgtgagactgcgaacttagtgaatgttgtgtgagttctaactgctctactgaccggccatttccttgtctctctccctgtcctctggcctccctgttccttgagacacaataattaataagtctacagcagactctgtgtgttcaagtgaaagaaagggtcatacttctagaaattaagcttagtaaggaaggcatgtcaaaagctgagacaggctgaaagctaggcctcttgcactggttagccaagttgtgaattcaaagaaaaggatcttgaagaaaattaaaaattctactccagtgcacacacacaaatgataagaaagcaaaacaaccttattgctgatatggagacagttttagtggtctggatagaagatcaaaccagccacacattaagccaaagcatgacccacagcaaggccctaactctcttcaattctgtgaaggctgagagaggtgaggaagctgcaggaagctgggagaggttggttcacaaggtttaaggaaagaagacagctctaaaacctacaagtggaaagcgaaccagcaagttgctgatgtggaagctgtagcaagttatccagaagatgtagctaaaatcattgacaaagatggctacactaaacaacggatcttcagtgtagttgaaacagccttctattggaagaagatgctatctaggactttcctagctagaggggagaaatgaatgcctagcttcaaagcttcaaaggacagcctgactctcttaagagctaacacagctggtgactttgggttaaagccaaagctcattaactgtttcaaaaatcctaaaactcttgttttttgttttttttttgagacggagtcttgctctgtcgtccaggctggagtgcagtggcgcaatctcggctcactgcaagctccgcctcccaggttcatgccattctcctgcctcagcctccccagtagctgagattacaggtgcctgccaccacgcccggctaattttttgcatttttttagtagagatggggtttcactctgctagccaggatggtctcgatctcctgacctcatgatccgcctgcctcggcctcccaaagtgctgggattacaggcatgagccaccacgcccggcccaaaaatcgtaggactctgaagactgatgctaaacctgctgtgtctgagctctataaatggaacaacaaagcctcgctggcagcacatctgtttgcggcatggtttactgtatattttaagcccactgttgagacctactgcttgggaaaaaaaaaaattcctttcaaaatactactgctgattgacaatacaccatgttacccaagagctctgctggagatgtgcgaagagattagcattgttttcgcgcctgctaccacgacatccagccgaagcccatggatcaaggcgtcattgtgactttcaaatctaactatttaagaaatacatttcaggctgggggaggggagaaaaaagaaaaaaaagaaaggaagaaaaaaatcatttcataaggctatagctgccatagatagtgattcctctgatggagctgggcaaagtaaacagaaaacctctggaaaggattcagcattccagatgccattaagaacattcaggatccgtgggaggagatcaaaatatcaacattaacaggagtttggaaaaagtgaattccaaccctcttggatgactctgaggaattcgagacttgagtaaaggaagtcatgcagatgtacagcaagagaatgagaagtggagcctgaagatgtaactgaactgctgcaatctcatgatcacacttgaatggatgaggagtcgcttcttataaatgagcaaaaaagtggtttcttggctgcaatcaactcttgttgcagatgctgtgaacactgttgaaatgacaaaggatttagaatattacgtaaacatagttgataaagcagcagcagggtttaagaggattgactcctattttgaaatgagttcggctgggagaagtggctcatgcctgtcgtcctagcactttgggaggccaaggcagacagagcacctgaggtaaggagttcgagaccagcctggccaacatggtgaaaccccctctctactaaaaataccaacatattagccaggcgtggtggcacgtgcctgtagtcccagctacttgggaggctgaggcagaaggatcacttgaacccaggaggcagaggttgcagtaagccaagactgcgccactgcactccagcctggtggacacagcaagcctccatctcaaaaaaaaaaaaaaaaaaaaaatgagttctactgtgaataaaatgttattaaacagcatttcatgctacagagaaatctttcacgaaaggaagagtcaatcaatgcagcgaacttgttgttttattttaagaaattgtcacggccatcccaaccctcagtgcccaaccaccctgatcaggcagccatcatcaaggcaaggccctccaccagcaaaaagatcatgaattgctgaaagctcaaatgatggttagcttttttagcaataaagcatttttaatgaaggaatgtacatgttttagatataatgctattacacatttaacatactacatatagtgtgagcataacttttacacgtactggaaaatcaaaaaatatgtgtggctcatctgttataatgtttgttttattgtggtgatctggagccaaggctgaaatatctctgaggtatgcctgtaatgtataagtgctagtagaaatgagttgtgcagaattgctatttttttcaatttttatatttgggttaatggtaatatactaagcgtccagtctataaacttcagcattcgttgcgaaatccagaggagacttttaagtgctgttttgtagatgaaatatgaaagagaaacaagggcttaatggtaaagatgacatatgactatattaagaaactgaatggccctttgtccacaaacagtaacccacacagcattgctactgtggcatgcccactgctctgcactgacctcatggagcagagaacctccttcagacacctcacgcaccccctgaggagctaatgtttcttcccaacatggaaaatttggaagaggcctattcttcacagctgtcacttctcattttgaaagaatatgcccacccttattcgcaggcaaggtgtgaggaggtctttgggctccagctgttgccagcagaggtggtgaaagtcaacaacagggcactggacacacatagaaatgtgacccacagctatggtttgcaaatacagtctttcaagaagtcctgccatgtcctaaatgcccaaaccccttgcctcccatgattcttctcctcaaaggaccttctgctggacgccgccccctccctctccagccccaccagggccctccccgccatcctcttaggccacagcagccaataaagagtgtttttattccatgatctgtacccccaatgaatccataatcatagtttcaaatgtatttaccaaaaatactaacattatctggaatgaatgaatgaatgaatgaatgaataaatattatatatttatacattttcattcttccaaagtgaaccccactatgccagttttactccatactcagtgttctggaaagcccatattctttctaaatttttcagcatttttttctatttttgtactttaccaaaattatttacattggaataaactctcttccttctgaattctgtagtaaaaa

SEQ ID NO: 1713 - DNA, 584 bp, Homo sapiens
  ENST00000571278
actccactcaagggaattctgtactttgccctttgggtaaagtctcatttacatttctaaacctttcttaagaaaatcgaatttcctttgatctctcttctgaattgcagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggagcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaagacttctctggctccactaccctgctacgtttatctgattgagcatccttccctcaaatatgcgaccactcgttccatagccaagtatcctgtgggtatagaagttggtcct

SEQ ID NO: 1714 - DNA, 4851 bp, Homo sapiens
  ENST00000551177
cgccccgggcctcctccgcgcagtccctgagtcccgcaggccctgcgtccccgctgcacacccccgtccactcccgtggtccccggtccggcatggcgcgcgcggtggggcccgagcggaggctgctggccgtctacaccggcggcaccattggcatgcggagtgagctcggcgtgcttgtgcccgggacgggcctggctgccatcctgaggacactgcccatgttccatgacgaggagcacgcccgagcccgcggcctctctgaggacaccctggtgctacccccggccagccgcaaccagaggattctctacaccgtgctggagtgccagcccctcttcgactccagtgacatgaccatcgctgagtgggtttgccttgcccagaccatcaagaggcactacgagcagtaccacggctttgtggtcatccacggcaccgacaccatggcctttgctgcctcgatgctgtccttcatgctggagaacctgcagaagactgtcatcctcactggggcccaggtgcccatccatgccctgtggagcgacggccgtgagaacctgctgggggcactgctcatggctggccagtatgtgatcccagaggtctgccttttcttccagaatcagctgtttcggggcaaccgggcaaccaaggtagacgctcggaggttcgcagctttctgctccccgaacctgctgcctctggccacagtgggtgctgacatcacaatcaacagggagctggtgcggaaggtggacgggaaggctgggctggtggtgcacagcagcatggagcaggacgtgggcctgctgcgcctctaccctgggatccctgccgccctggttcgggccttcttgcagcctcccctgaagggcgtggtcatggagaccttcggttcagggaacggacccaccaagcccgacctgctgcaggagctgcgggtggccaccgagcgcggcctggtcatcgtcaactgtacccactgcctccagggggctgtgaccacagactatgcagctggcatggccatggcgggagccggcgtcatctcaggcttcgacatgacatcggaggccgccctggccaagctatcgtatgtgctgggccagccagggctgagcctggatgtcaggaaggagctgctgaccaaggaccttcggggggagatgacgccaccctcggtggaagagcgccggccctcactgcagggcaacacgctgggcggtggggtctcctggctcctcagtctgagcggcagccaggaggcagatgccctgcggaatgccctggtgcccagcctggcctgtgctgctgcccacgccggtgacgtggaggcgctgcaggcgcttgtggagctgggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggcatccgggtgtcattgggttgctgcgggaagccggggcctccctgtccacccaggagctggaggaagcagggacggagctgtgcaggctggcatacagggccgacctcgaaggcctgcaggtgtggtggcaggcaggggctgacctggggcagccgggctatgacgggcacagcgccctgcacgtcgcagaggcagccgggaacctggcagtggtggcctttctacagagcctggagggtgcggttggtgcccaggccccatgcccagaagtgctgcctggtgtctaacctgaaggcgtcctgctgcagtataagccattccttcctcccatgacctgctggaggggtctcaggcatgaccccactgctggggctgcttcccagcctgctctcatgtaaagcctgaaggcctttgttgggcaggacggcaataaagtctctgacatcccctcaccaggtctgtacagcctggctctgagaggctctgtctgggtccgggactgtggatgtgtgtggggagtcaggcccaggctctgtggggtctctgcgggggtcacttggcccatccttccgggggcagctgtgcgtgtgagctgggcagggtggggtgcatggacgtgacttggccaagtggtcctttcccagctgccactcccccttcctgccaccctgcctttgcccaggctggtccctcctccagacaccctctgcccatctccttacctcctgcgccttcattctggagcttgaagtcccctcccccaggcagccctccaacccctggatgagcatgctgcccctgcttaactctttagtcctcacagtcccgtcccagttgctgtctggttttctgtcaccccagtatcgctgcacccggcccccctctcaggccagggccacaccagggctccatagggctgcggaagcctgtgagtgtcaagggggcttcacactctggtggtgagcccctggggaccattccagcccctgctctgcctgaagctcctgatgcagcctccaccgtgagccaggccaccctgtaagggaagaggtgagctgtgcctgcctggttgcacagcctgggcaggtgggcgggtggggcgggccctgctgctgcccggtgggggtggtgctccaaggccaagggcagcctcgtgccttctttcagctggggctgaaatcgggggtgtggacccctggcccccatcatgtgtgcatgcactggcctgggatggccagggactccctgctgctgcccccagcccctgaccccttcttgctgggtgtgaggagcatgggggctgcctccctccaggcctctctacctgcccaggtgacggttccttttgtccctctgtttggctggcctctggactggagccccaggagggcaaaagcatgaccccagagctggcccttggcacctgggcataccccaggctcctcagcctggttcccaagcctggctggtactgccgctggcatccttgctgtcctcaccccgacacaggtgtgcctgggccttgcacaacaaggtgacgccatgcgagcgtggcagggccggggaagcctttgctcctcaccctggtgaggcccatgaggggctgcaggtggagggagggtggcaccgggccccagagccaggagcccctgctgtccccggatggccgagacccttggagggccttgggagaggcggtggggcatctggacaaatgcctggtgcaggtgagaaggggtgggactacctccggcatccctgggctgagcccacctggtctccccggttgctcctgcacacggcagtgcccacctgcttccctcagctcctgaggggctgggcagagcctgttgctcacgccaccccactcagtgctgctccgggttgtgaaagctgcaggtggctcacgttagcccacatggcagcaccctcccagagcaggtgccaacctgccagtgtagacacaccgactgatgccgggggtgagtgtcctgtagtgtagaaacgcccactcatcctgcttgtcccgcagagagcatttgtcaagctggcctttctccaactgggtcactgatggagttcggcagagacggcttgggggccacgggctgggcagatggggagagctcctcacaaggctgggcagccagacccccattgtcagtcccctccaaaccctcgtgggatgtagggccctaccacagggagccccgggactgggccagtgtctcaggaggctgtgaagagtcataggcttgagtctgggagctttctcgggggccgttttgtgccccttggggagaggccagaggggccctgggtaaggggactcctctagaatcacccagaagtggcaggaggtgcagggccactgctcggggctccctgggctctgagctgggcagtgacctggccccaaggcctctggctctctggcgtgcagtgggaacagccgggacagacaggcttggagcgttcgtgtcctgcgccgcgttggtgtgtttcgtccccactgtgcctgtaggagggcaccgggtccccgtctatcctacttcatggctgaggaagctaaggcacagagtggccccgtcctgcgcccagggctctgcgttggcacagggcagagctgggctgtgaatcagggccgccttgtctcttgctgtggtgtgaggctgtgggagactcaggaatgaggcacagccaggtgcccagtgcccgtgggacccgcctccccacagtggggtggcgccgctcacacctggtaatttcacgctgggggaggccttggttcctatagcccatctcgaatcacctggatcccagggctatctctggggaacatctcctctccatcacgactactgtctttttcaccagcattttctatcctaaaatcagactcctcagctgagggccctccaggaccgcccttccccagctggaggtaaccagatttctcgtgtatgctaggaagttccccttctggtcacacctcaatatttcctgctgctggtgggaactgcaggtgcttgtacttgtcaccttctccccgtcctctctcgtcagttcccttggatgctggacacgggagccacctgggcgaggggagcccatccaagtggctgtgcgtcgggaagagtctgcccaggactgggctagaccagaacttagaattaaggagtggtggccaggcttggtggctcacacctgcaatcccagcactttgggaggccgaggcgggtggatagcttgagcctaggagtttgagaacagccaacatggcgaaactctgtctcttaaaaaataaataaaaacattagccag

SEQ ID NO: 1715 - DNA, 2157 bp, Homo sapiens
  ENST00000548372
ggcctcctccgcgcagtccctgagtcccgcaggccctgcgtccccgctgcacacccccgtccactcccgtggtccccggtccggcatggcgcgcgcggtggggcccgagcggaggctgctggccgtctacaccggcggcaccattggcatgcggagtgagctcggcgtgcttgtgcccgggacgggcctggctgccatcctgaggacactgcccatgttccatgacgaggagcacgcccgagcccgcggcctctctgaggacaccctggtgctaccgtgagtgtgggctcctcccagtcccggacagggcatggctgctgaggggcaccgatcctgaggctgggcactgctggccaggcccacgtgagccatttgctcacccctgtctctaacatcccctcagcttacagggctttaggactgaccagcagtcgccttccaccagagcctgaacctctgagggtgccccgtgcctggtcccaccttccctccccaccctcctcccacacccccagccaggctgcttcggcaagtgtgatgagggcgccccgtctagggatcctgtatatcaggagccagctggcccaggtggccttgcccccagcatagaggtccttccatttctcagctctgggcccagctccctgatgtcccccacagctgggggtgagctgggagttgccctcgtggtggctgaccaccacagccgccacaggcgagcctcctgcaagcatcctctcctgcctggggatggctggtcccagcccccctcttcgagctggtgtgggaagaagactgctgggagtggcccatcctgacctacgtccttgcctctgtggggagctccaggtggaaggggggccgggccccgtacctgggatgctgagaacttgctatgtgcggagcccttggcgtaggggccccagctctgccagaggggaacagagcgggtcagggcatttagagcaggaggaggtgcagagcgggagcctgctgttccgcctcctgctgtttctgtcccgcagcccggccagccgcaaccagaggattctctacaccgtgctggagtgccagcccctcttcgactccagtgacatgaccatcgctgagtgggtttgccttgcccagaccatcaagaggcactacgagcagtaccacggctttgtggtcatccacggcaccgacaccatggcctttgctgcctcgatgctgtccttcatgctggagaacctgcagaagactgtcatcctcactggggcccaggtgcccatccatgccctgtggagcgacggccgtgagaacctgctgggggcactgctcatggctggccagtatgtgatcccagaggtctgccttttcttccagaatcagctgtttcggggcaaccgggcaaccaaggtagacgctcggaggttcgcagctttctgctccccgaacctgctgcctctggccacagtgggtgctgacatcacaatcaacagggagctggtgcggaaggtggacgggaaggctgggctggtggtgcacagcagcatggagcaggacgtgggcctgctgcgcctctaccctgggatccctgccgccctggttcgggccttcttgcagcctcccctgaagggcgtggtcatggagaccttcggttcagggaacggacccaccaagcccgacctgctgcaggagctgcgggtggccaccgagcgcggcctggtcatcgtcaactgtacccactgcctccagggggctgtgaccacagactatgcagctggcatggccatggcgggagccggcgtcatctcaggcttcgacatgacatcggaggccgccctggccaagctatcgtatgtgctgggccagccagggctgagcctggatgtcaggaaggagctgctgaccaaggaccttcggggggagatgacgccaccctcggtggaagagcgccggccctcactgcagggcaacacgctgggcggtggggtctcctggctcctcagtctgagcggcagccaggaggcagatgccctgcggaatgccctggtgcccagcctggcctgtgctgctgcccacgccggtgacgtggaggcgctgcaggcgcttgtggagctgggcagtgacctgggcctggtggactttaacggccaaaccccactgcacgcggcc

SEQ ID NO: 1716 - DNA, 1791 bp, Homo sapiens
  ENST00000546892
cctccgcgcagtccctgagtcccgcaggccctgcgtccccgctgcacacccccgtccactcccgtggtccccggtccggcatggcgcgcgcggtggggcccgagcggaggctgctggccgtctacaccggcggcaccattggcatgcggagtgagctcggcgtgcttgtgcccgggacgggcctggctgccatcctgaggacactgcccatgttccatgacgaggagcacgcccgagcccgcggcctctctgaggacaccctggtgctacccccggccagccgcaaccagaggattctctacaccgtgctggagtgccagcccctcttcgactccagtgacatgaccatcgctgagtgggtttgccttgcccagaccatcaagaggcactacgagcagtaccacggctttgtggtcatccacggcaccgacaccatggcctttgctgcctcgatgctgtccttcatgctggagaacctgcagaagactgtcatcctcactggggcccaggtgcccatccatgccctgtggagcgacggccgtgagaacctgctgggggcactgctcatggctggccagtatgtgatcccagaggtctgccttttcttccagaatcagctgtttcggggcaaccgggcaaccaaggtagacgctcggaggttcgcagctttctgctccccgaacctgctgcctctggccacagtgggtgctgacatcacaatcaacagggagctggtgcggaaggtggacgggaaggctgggctggtggtgcacagcagcatggagcaggacgtgggcctgctgcgcctctaccctgggatccctgccgccctggttcgggccttcttgcagcctcccctgaagggcgtggtcatggagaccttcggttcagggaacggacccaccaagcccgacctgctgcaggagctgcgggtggccaccgagcgcggcctggtcatcgtcaactgtacccactgcctccagggggctgtgaccacagactatgcagctggcatggccatggcgggagccggcgtcatctcaggcttcgacatgacatcggaggccgccctggccaagctatcgtatgtgctgggccagccagggctgagcctggatgtcaggaaggagctgctgaccaaggaccttcggggggagatgacgccaccctcggtggaagagcgccggccctcactgcagggcaacacgctgggcggtggggtctcctggctcctcagtctgagcggcagccaggaggcagatgccctgcggaatgccctggtgcccagcctggcctgtgctgctgcccacgccggtgacgtggaggcgctgcaggcgcttgtggagctgggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggcatccgggtgtcattgggttgctgcgggaagccggggcctccctgtccacccaggagctggaggaagcagggacggagctgtgcaggcagaggcagccgggaacctggcagtggtggcctttctacagagcctggagggtgcggttggtgcccaggccccatgcccagaagtgctgcctggtgtctaacctgaaggcgtcctgctgcagtataagccattccttcctcccatgacctgctggaggggtctcaggcatgaccccactgctggggctgc

SEQ ID NO: 1717 - DNA, 377 bp, Homo sapiens
  ENST00000551170
cccggccagccgcaaccagaggattctctacaccgtgctggagtgccagcccctcttcgactccagtgacatgaccatcgctgagtgggtttgccttgcccagaccatcaagaggcactacgagcagtaccacggctttgtggtcatccacggcaccgacaccatggcctttgctgcctcgatgctgtccttcatgctggagaacctgcagaagactgtcatcctcactggggcccaggtgcccatccatgccctgtggagcgacggccgtgagaacctgctgggggcactgctcatggctggccagtatgtgatcccagagctgctgaccaaggaccttcggggggagatgacgccaccctcggtggaagagcgcc

SEQ ID NO: 1718 - DNA, 387 bp, Homo sapiens
  ENST00000549809
ctggactcccagcccaggctccgcctgtccttgtgccttctcagactgcatggagacctgaggctcccctaactgtcgccaggaaatcctctcctgctctccactcttcctcgaggctgctgaccaaggaccttcggggggagatgacgccaccctcggtggaagagcgccggccctcactgcagggcaacacgctgggcggtggggtctcctggctcctcagtctgagcggcagccaggaggcagatgccctgcggaatgccctggtgcccagcctggcctgtgctgctgcccacgccggtgacgtggaggcgctgcaggcgcttgtggagctgggcagtgacctgggcctggtggactttaacggccaaaccccactgcacgcgg

SEQ ID NO: 1719 - DNA, 244 bp, Homo sapiens
  ENST00000552126
tgccttctcagactgcatggagacctgaggctcccctaactgtcgccaggaaatcctctcctgctctccactcttcctcgaggctgctgaccaaggaccttcggggggagatgacgccaccctcggtggaagagcgccggccctcactgcagggcaacacgctgggcggtggggtctcctggctcctcagtctgagcggcagccagggcagtgacctgggcctggtggactttaacggccaaac

SEQ ID NO: 1720 - DNA, 171 bp, Homo sapiens
  ENST00000556267
gacctgaggctcccctaactgtcgccaggaaatcctctcctgctctccactcttcctcgagggtggggttcagacacagctggccccagacccttgggttgccagcctctggggctggacggaggcttttggggcccctggagaccctgagctgctgctgaccaaggacct

SEQ ID NO: 1721 - DNA, 467 bp, Homo sapiens
  ENST00000550583
gcggccgcccggggaggccacacagaggcagtcaccatgctgctgcagagaggtgtggacgtgaacacccgggacacggatggcttcagcccgctgctgctggccgtgcggggcaggcatccgggtgtcattgggttgctgcgggaagccggggcctccctgtccacccaggagctggaggaagcagggacggagctgtgcaggctggcatacagggccgacctcgaaggcctgcaggtgtggtggcaggcaggggctgacctggggcagccgggctatgacgggcacagcgccctgcacgtcgcagaggcagccgggaacctggcagtggtggcctttctacagagcctggagggtgcggttggtgcccaggccccatgcccagagccctcatgttttcaggaagtgctgcctggtgtctaacctgaaggcgtcctgctgcagtataagccattccttcctcccat

SEQ ID NO: 1722 - DNA, 565 bp, Homo sapiens
  ENST00000551871
gcaccctctccaaaggctgccacctccaggaaggacacctggacaattcaccagctcactgctctgcccctccccgctctgcccctcccccaaatgcctggccctccccatgcaggacccgcacagactgggtccccttcccggggctctgagtggtgggggtgacgagagtggaggagctgctggggccctgtgtgtgtgggctggggacaggggagggcatcctggggatggggatccttgggccaggctgctagtcagtggccccaaggcagcccctccccactgcttccccataggcagaggcagccgggaacctggcagtggtggcctttctacagagcctggagggtgcggttggtgcccaggccccatgcccagaagtgctgcctggtgtctaacctgaaggcgtcctgctgcagtataagccattccttcctcccatgacctgctggaggggtctcaggcatgaccccactgctggggctgcttcccagcctgctctcatgtaaagcctgaaggcctttgttgggcaggacggcaataaagtctctgacatcccctc

SEQ ID NO: 1723 - DNA, 2356 bp, Homo sapiens
  ENST00000288520
ccaagcgcgcggggcaaggcggccctgcaggggtgagctttcctctgagaacccggggccttagcgacacgtaatccagttttccgtctccttggtgcagatgaagaaaccgacgcccatgggcgaaagggacctgctcaagttcactcagtaagtcaggagataagccagaatgcgtatctgactccagtctcaatgtctaccccttcacaaaacggtagcctccagggtagtcctcagcaaagcgttggcaccttactgaatctgtttttccatctgagaaatgggccaacggaaaaatcaaacttccattctggggaagtcgagaaccgggactccctaggaagggcagtgctttggcctcatgttctgtgctctgacagagagctgcactagagacaagtttatccatgaacacattgctctgtaaaggaatgttttgcctactcagctgggaggccgacagcagaggcagacttggggagtacactctgcagcccctgtccctgcagactgaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctc

SEQ ID NO: 1724 - DNA, 1757 bp, Homo sapiens
  ENST00000341734
gcttgtcgtgcagctggccccaagcgcgcggggcaaggcggccctgcaggggtgagctttcctctgagaacccggggccttagcgacacgtaatccagttttccgtctccttggtgcagatgaagaaaccgacgcccatgggcgaaagggacctgctcaagttcactcaagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctc

SEQ ID NO: 1725 - DNA, 3812 bp, Homo sapiens
  ENST00000373986
caaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaagcagcagctgaggcgactcaggagacagtggagtccctgatgcagaagttcaaggagagtttccgcgctaacacgcccatcgagatcggtcagctgcaaccacccctgcgcagcacatcggcagggaagaggaagcggaggagcaagtctcgaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctc

SEQ ID NO: 1726 - DNA, 4622 bp, Homo sapiens
  ENST00000361209
ggctctctccgctccttagctcgggcgtcctggttcgcttcggcgtccgccgtctccgcagctgcctcctcttcctccttcgccaccgccgccaccgccgccgccgcccgcagcaccgcagcccctcccgccatggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcagcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcaggtctactttcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctc

SEQ ID NO: 1727 - DNA, 395 bp, Homo sapiens
  ENST00000417725
agatggcctacaacacactgatggaggtctcagcctcgatgctgttccgagtccagcaccactacaactctcactatgaaaagtttggcgacttcgtctggagaagtgaggatgagctggggcccagcctcctggaatcctttatgagcctccaggacataaatcttctggaaaggcggccgggccgcccacagaggccaggcaatccactcagtaatgtctcctggaggatatctgagattgctccaacatcccacactgatatgtcagcaggaatcaaggaaactgcctcctaatctatcctggtgctgctaataagctcactgtgcaaccctgggctctgccgctttctggccctcagtctcctcacctataacatgataaggacgaactag

SEQ ID NO: 1728 - DNA, 3411 bp, Homo sapiens
  ENST00000358637
ctggccccaagcgcgcggggcaaggcggccctgcaggggtgagctttcctctgagaacccggggccttagcgacacgtaatccagttttccgtctccttggtgcagatgaagaaaccgacgcccatgggcgaaagggacctgctcaagttcactcaagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacagtttattgctggattacatttattgatttgcggatattgaaccagccttgcatcccagggatgaagccaacttgattgtggtggataagctttttgatgtgctgctggatttggtttgccaatattttattgaagatttttgcatcgatgttcatcagggatattggtctaaaattctctttttttgttgtgtctctgccaggctttggtatcaggatgatgttggcctcataaaatgaattagggaggattccctctttttctattgatttgaatagtttcagaaggaatggtaccagctcatctttgtacctctggtagaattcggctgtgaatccatctggtcctggacttattttggttagtaggctattaattatggcctcaatttcagaacctgttattggtctattcagggattcaacttcttcctggtttagtcttgggaggaggctgtatgtgtccaggaatttatccatttcttctagattttctagtttatttgcatagaggtgtttatagtattctctaatggtagtttgtatttctgtgggatcggtggtgatatcccctttatcattttttattgcgtctatttgattcttctctcttttattctttatgagtcttgctagtagtctatcaattttgttgattttttcaaaaaaccagctcctggattcattgattttttgaagggtttttttttttttgtctctatctccttcagttctgctctcatcttagttatttcttgccttctgctagcttttgtgtgtttgctcttgcttctctagttcttttaattatgatgttagggtgtcagtttcagatctttcttgctttctcctgtgggcatttagtgctataaatctccctctacacactgctttaaatgtgtcccagagattctggtatgttgtgtcctgttctcattggtttcaaagaacatctttatttccgctttcatttcgttatgtacccagtagtcattcaggagcaagttgttcagtttccatgtagttgagcggttttgagtgagtttcttaatcctgagttctagtttgattgcactgtgttctgagagacagtttgttataatttctttcttttacatttgctgaggagtgctttacttcccactgtgtgatcaattttggaataactgcgatgtggtgctgagaagaatgtatattctgttgattggggtggatagttctgtagatgtctattaggtccgcttggtgcagagctgagttcaattcctggatatccttgttaactttctgtctcattgatctatctaatgttgacagtggggtgttaaagtctcccattattattgtgtgggagtctaagtctctttgtaagtctctaaggacttgctttatgaatctgggtgctcctatattgggtgcatatatatttaggatagttagctcgaagaaggtatcttctatttctagtctgctgcaaaggctctgttttgtttccattggaaacagatgttgaattttctgtgtctattaaaatgattgtatagtttatctctctaaatttgttaatatgataagtcacattgatagattttcatattataaaacaacctactatgtgagatttatcccaggaatgtgtaggttgttttatctgtttgttttaattaggatcattctggtctcacaaaatgaattataaaatattttctccttttcagttttctgaagtgtatctgtcttctcagagaatcactgtggttaaaattgatagtatttttttcttaatcattttttagaattcaccagtgaaggcatctgggcttagaccttttcttgcaagaaggtttttaactactaatttagttatttaatagatatagatttacttagattatctgtttcttcttgagtgatctttggcagcttgtgtgttttaaggaacttgttcattccatgtaaattatcaaatttattggaaaaagttgtttatgacattccgttactattcttttgaaatctgttgagattatagtgatattagtctcatcttgatattggtaatgtgtgtctcctctgttttttttctagatcagtttggctagatagctatgacatttatttgtattttcaaagaatcaactttcggttttatctgtttttgcttattgtttcctatttcattgatttatcctctaatttttattataattttctttgtttggcttactttgagtttggttttctccgcattttaatttttgaaatggtagctgaggctattgatttgagacctttcttgtaatgtagtcattccctcttaactactgctttagtagtatctcaaagattgtgttatgttgcgttttcattttcattcagttcaaagtatttccaatttcacttttgttttcttctttgacttatgagttatttagaggcatgccacttcgttttcaaatatttgggagttttttcagaaatttttgttgttgatttttgattccgctatagtcagaaaatatgtttttatgactttaaacattttaaatttattgagactagtttttggtctagatggtctattgctgtattcagtgttcactttaaaataatgtgtatccacttatttatgggtattttataaatgcctgttagataaaatcggttaattatgttattcaagtcttctggagcctttctgattttct

SEQ ID NO: 1729 - DNA, 4001 bp, Homo sapiens
  ENST00000361477
ggttcgcttcggcgtccgccgtctccgcagctgcctcctcttcctccttcgccaccgccgccaccgccgccgccgcccgcagcaccgcagcccctcccgccatggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcagcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcaggtctactttcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccgatattatttgactctatcaaaagtctctcctttttaa

SEQ ID NO: 1730 - DNA, 4747 bp, Homo sapiens
  ENST00000313400
ggttcgcttcggcgtccgccgtctccgcagctgcctcctcttcctccttcgccaccgccgccaccgccgccgccgcccgcagcaccgcagcccctcccgccatggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcagcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaagcagcagctgaggcgactcaggagacagtggagtccctgatgcagaagttcaaggagagtttccgcgctaacacgcccatcgagatcggtcagctgcaaccacccctgcgcagcacatcggcagggaagaggaagcggaggagcaagtctcgaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcaggtctactttcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctcttt

SEQ ID NO: 1731 - DNA, 4995 bp, Homo sapiens
  ENST00000517666
cggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattccctcgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatttcttggtttacttttgtaattatatacacaacaaatgtattaataactaccttgttaaacaccttttaatagcacaaggtttttatatttgcaagctgttgatatctttctaaaactgtttaggttatagtctattgatactttttatatacaattttataaatataaatattataattttatattaatggtaccaaaaatacatttcttaaggttaaaagcatgcacttccatgcatacttgcttttggggagagtggggagaagacattctaataatcagtttgtgaaatagcttctgttggaaaccttttgaggggaataaggaatggtcatctaaaatgagagattctggattttaatgcagttcaaagttgagctgtatttttgttgttgatttatctggattttttttaaagccttctaaaacccagtgaattcaataccttaattagtacatactatcttatgtaatgcataaagcaatgccagtcactgagaacatttaaatatatttatattcctggagatacacattctcatttttgttggtttattataaattattcttctagatgcatcttttataactaggatttcattttgtgtgtatagcttatgtaataaattttaaaggtgaaaactctcttaaa

SEQ ID NO: 1732 - DNA, 5565 bp, Homo sapiens
  ENST00000287394
cgcggagcttgtggcgccagaattcggagcgcggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattccctcgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatttcttggtttacttttgtaattatatacacaacaaatgtattaataactaccttgttaaacaccttttaatagcacaaggtttttatatttgcaagctgttgatatctttctaaaactgtttaggttatagtctattgatactttttatatacaattttataaatataaatattataattttatattaatggtaccaaaaatacatttcttaaggttaaaagcatgcacttccatgcatacttgcttttggggagagtggggagaagacattctaataatcagtttgtgaaatagcttctgttggaaaccttttgaggggaataaggaatggtcatctaaaatgagagattctggattttaatgcagttcaaagttgagctgtatttttgttgttgatttatctggattttttttaaagccttctaaaacccagtgaattcaataccttaattagtacatactatcttatgtaatgcataaagcaatgccagtcactgagaacatttaaatatatttatattcctggagatacacattctcatttttgttggtttattataaattattcttctagatgcatcttttataactaggatttcattttgtgtgtatagcttatgtaataaattttaaaggtgaaaactctcttaaa

SEQ ID NO: 1733 - DNA, 5143 bp, Homo sapiens
  ENST00000521903
aggtttgggcttggagttgggccctgaatggcgctttgctgtgaatctccgcggggaggctcttccaaccaggggctgagcttctgcgctgtggagaagccaggatctcatttgcctctttcaacatcactcctgctggagccaccaccagctcaatccttggcatcatcacctcactgaggagggtggtgtggtccttctcagcaagaaagtcgatgtctcgggaagtgacgatgcccaccggcttgctgcccatggtgcctgtctcagtgatggggataccagagaagccatgccgcatcgtggcctccagcacatcacccacagggtgcgaggggctcagcaccatggggtccgtgatgaagccatgttcaaacttcttgaccttccgcacctccttggcctggaactctggggtgcagttgtggtgaatgaaaccaatacctcccaccagagccatcgtgatggccatgttgccctctgtcacagtgtccatggaggaggagatcagcggcgtcttcagcgtgatcttccaggatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattccctcgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatt

SEQ ID NO: 1734 - DNA, 4650 bp, Homo sapiens
  ENST00000519124
ccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgtgagatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcc

SEQ ID NO: 1735 - DNA, 3133 bp, Homo sapiens
  ENST00000521496
gatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtaatttatgtggggcggtatcattatactttcaaaaagagttgtttctaccacaataatcataacttattgaaaaaattcaaatgctgtagaagtgaataaaaggataagttttcttatcaaatataccattggtaactatttggtatatgtgctcattgggcaagatggtatatgtatatgtgtatgtatatattaaggatacataaattttttctcttgaaaaatggtattatatgccgggtgcagtggctcacgcctgtaatcccagcactttgggaggccgaggtgggtggatcatgaggtcaggagattgagaccatcctggctaacagggtgaaaccctgtccctactaaaaatacaaaaaaaa

SEQ ID NO: 1736 - DNA, 438 bp, Homo sapiens
  ENST00000550993
gattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacaggtaaaacttgcttgatggcacttcaacgtttcttcctatttcctgagtggtattgatgtgtgagagatagaatgttaaatggtgaaagaaactttataagctagtagttcctttttttggtagtagaaccccagtatatagtacaaaaataaaaaatgtggatggttgcagtggctcatacctgtattcctggcactttgggaggccaaggcaggcagatcacttgaggtcaagagtttgagaccagcctggccaacatggtgaaatcctgtctctactaaaaaaaaaa

SEQ ID NO: 1737 - DNA, 544 bp, Homo sapiens
  ENST00000534257
gtgctatacatgttatcagctgcaaccctctggacataaatgacttaaaatatgaacagcaaaatattccatagtagatatttactagtacttcatggaaggcgataagcacctttaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaa

SEQ ID NO: 1738 - DNA, 411 bp, Homo sapiens
  ENST00000530065
tgttatgaactataaaccagtaaatcttatattagctgcttcatagacattgctgatatttgtttatcatgaaatggtttttctagatactaacttgtagtttcttggggagatacaaaatgattctgcacaaaaagcagtttttactaacttgtaatcagagaatactctttggaggaatttaaattggagttttgtaaagaaaaacttagatggctttcttaatttttcttaaaggatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgat

SEQ ID NO: 1739 - DNA, 680 bp, Homo sapiens
  ENST00000366981
ggcggaggtggggttagcttcagttgaccaaccatgccttgaggataaattggatgggatcagatgggaagatgtgacaagaagagaaatcctcctctatataggatgctctgctgtttcctaaggattttcagcaccttgccccaaaatcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaag
